(12) United States Patent
Gilboa-Geffen et al.

(10) Patent No.: US 11,034,963 B2
(45) Date of Patent: Jun. 15, 2021

(54) ALLERGEN DETECTION AGENTS AND ASSAYS

(71) Applicant: DOTS Technology Corp., Natick, MA (US)

(72) Inventors: Adi Gilboa-Geffen, Wayland, MA (US); Valerie Villareal, Boston, MA (US); Sarah Stidham, Brighton, MA (US); Morris Nehama, Needham, MA (US)

(73) Assignee: DOTS TECHNOLOGY CORP., Natick, MA (US)

( * ) Notice: Subject to any disclaimer, the term of this patent is extended or adjusted under 35 U.S.C. 154(b) by 0 days.

(21) Appl. No.: 16/347,935

(22) PCT Filed: Nov. 8, 2017

(86) PCT No.: PCT/US2017/060487
§ 371 (c)(1),
(2) Date: May 7, 2019

(87) PCT Pub. No.: WO2018/089391
PCT Pub. Date: May 17, 2018

(65) Prior Publication Data

US 2019/0292544 A1 Sep. 26, 2019

Related U.S. Application Data

(60) Provisional application No. 62/512,299, filed on May 30, 2017, provisional application No. 62/435,106, filed on Dec. 16, 2016, provisional application No. 62/418,984, filed on Nov. 8, 2016.

(51) Int. Cl.
| | | |
|---|---|---|
| *C12N 15/115* | (2010.01) | |
| *C12N 15/10* | (2006.01) | |
| *G01N 33/02* | (2006.01) | |
| *G01N 33/533* | (2006.01) | |
| *C12Q 1/6816* | (2018.01) | |

(52) U.S. Cl.
CPC ........ *C12N 15/115* (2013.01); *C12N 15/1048* (2013.01); *C12Q 1/6816* (2013.01); *G01N 33/02* (2013.01); *G01N 33/533* (2013.01); *C12N 2310/16* (2013.01); *C12N 2310/3517* (2013.01); *C12N 2310/3519* (2013.01); *C12N 2320/10* (2013.01)

(58) Field of Classification Search
None
See application file for complete search history.

(56) References Cited

U.S. PATENT DOCUMENTS

| | | | |
|---|---|---|---|
| 10,344,319 B2 * | 7/2019 | Gilboa-Geffen | ..... C12Q 1/6818 |
| 10,466,246 B2 * | 11/2019 | Gilboa-Geffen | ....... A61K 38/00 |
| 2006/0014172 A1 | 1/2006 | Muller et al. | |
| 2010/0240544 A1 | 9/2010 | Liu et al. | |
| 2014/0350235 A1 | 11/2014 | Akhras et al. | |
| 2016/0251703 A1 | 9/2016 | Gilboa-Geffen et al. | |

FOREIGN PATENT DOCUMENTS

| | | | | |
|---|---|---|---|---|
| WO | 2010121223 A2 | 10/2010 | | |
| WO | 2011045570 A2 | 4/2011 | | |
| WO | 2013116527 A1 | 8/2013 | | |
| WO | WO-2015066027 A2 * | 5/2015 | ........... | C12Q 1/6818 |
| WO | 2018089391 A1 | 5/2018 | | |

OTHER PUBLICATIONS

International Search Report and Written Opinion for corresponding PCT Application No. PCT/US2017/060487 entitled "Allergen Detection Agents and Assays" dated Mar. 13, 2018.
Amaya-González et al., Aptamer-Based Analysis: A Promising Alternative for Food Safety Control, Sensor, 2013, 13, 16292-16311; doi:10.3390/s131216292.
Algar et al., Beyond labels: A review of the application of quantum dots as integrated components of assays, bioprobes, and biosensors utilizing optical transduction, Analytica Chimica Acta, 2010, 673, 1-25.
Eickenberg et al., Lab-on-a-Chip Magneto-Immunoassays: How to Ensure Contact between Superparamagnetic Beads and the Sensor Surface, Biosensors, 2013, 3, 327-340; doi:10.3390/bios3030327.
Janissen et al., Invincible DNA tethers: covalent DNA anchoring for enhanced temporal and force stability in magnetic tweezers experiments, Nucleic acid Research, 2014, 1, doi: 10.1093/nar/gku677.
Jasim et al., Synthesis of few-layered, high-purity graphene oxide sheets from different graphite sources for biology, 2D Materials, 2016, 3, doi:10.1088/2053-1583/3/1/014006.
Jensen et al., Direct oligonucleotide synthesis onto superparamagnetic beads, Biotechnol. Sep. 20, 2013; 167 (4): . doi:10.1016/j.jbiotec.2013.08.006.
Paulchamy et al., A Simple Approach to Stepwise Synthesis of Graphene Oxide Nanomaterial, J. Nanomed Nanotechnol., 2015, 6:1, doi.org/10.4172/2157-7439.1000253.
Philippova et al., Magnetic polymer beads: Recent trends and developments in synthetic design and applications, European Polymer Journal, 2011, 47, 542-559.
Shahriary and Athawale, Graphene Oxide Synthesized by using Modified Hummers Approach, International Journal of Renewable Energy and Environmental Engineering, 2014, 2(1), 58-63.
Song et al., Aptamers and Their Biological Applications, Sensors, 2012, 12, 612-631; doi:10.3390/s120100612.
Weng et al., A microfluidic biosensor using graphene oxide and aptamer-functionalized quantum dots for peanut allergen detection, Biosensors and Bioelectronics, 2016, 85, 649-656.

\* cited by examiner

*Primary Examiner* — Brian Whiteman

(74) *Attorney, Agent, or Firm* — DT Ward, PC; Donna T. Ward; Lingyun Jia

(57) ABSTRACT

The present application discloses nucleic acid aptamer based signaling polynucleotides (SPNs) that specifically bind an allergen protein. Provided in the present invention include aptamers, SPNs, SPN-complement complexes, magnetic particle conjugates, DNA printed glass slides and detection agents, and detection methods using the same for detecting the presence, or absence of an allergen protein in a food sample.

32 Claims, 22 Drawing Sheets

Specification includes a Sequence Listing.

Fluorescence Off

Fluorescence On

Dual Dye

N=5; LOD: Peanut Protein 1.25ppm

N=3; LOD: Peanut Protein 1.25ppm

ALLERGEN DETECTION AGENTS AND ASSAYS

CROSS REFERENCE TO RELATED APPLICATIONS

This application is a 35 U.S.C. § 371 U.S. National Stage Entry of International Application No. PCT/US2017/060487 filed Nov. 8, 2017 which claims priority to U.S. Provisional Application Ser. No. 62/418,984, filed on Nov. 8, 2016; U.S. Provisional Application Ser. No. 62/435,106, filed on Dec. 16, 2016; and U.S. Provisional Application Ser. No. 62/512,299, filed on May 30, 2017; the contents of each of which are incorporated herein by reference in their entirety.

REFERENCE TO SEQUECING LISTING

The present application is being filed along with a Sequence Listing in electronic format. The Sequence Listing is provided as a file entitled 20661007US371SEQLST.txt, created on May 7, 2019, which is 2,515,112 bytes in size. The information in the electronic format of the sequence listing is incorporated herein by reference in its entirety.

FIELD OF THE INVENTION

The present invention relates to nucleic acid based signaling polynucleotides (SPNs) for detecting allergen proteins. Detection agents comprising SPNs of the present invention can be used as novel biosensor platforms.

BACKGROUND OF THE INVENTION

Allergy is a serious medical condition affecting millions of people worldwide, with about 15 million people in the United States, including many children. During an allergic reaction, the immune system mistakenly targets an allergen as a threat and attacks it. The allergic reaction may affect the skin, the digestive system, the gastrointestinal tract, the respiratory system, the circulatory system and the cardiovascular system; in some allergic reactions, multiple organ systems are affected. Allergic reactions range from mild to severe or life-threatening. Severe symptoms may include difficulty in breathing, low blood pressure, chest pain, loss of consciousness, and anaphylaxis. People having allergies currently manage their allergies by avoiding any food that might contain that specific allergen. These restrictions have a major impact on the patients' quality of life and there remains no method for assessing the true allergen content of food. In the United States, food allergy symptoms send someone to the emergency room every three minutes.

Though antibody-based immunoassays are commonly used for food allergen detection, given the fact that antibodies to allergens are not easily to be obtained, there is an unmet demand of new platform technology to improve in vitro allergen detection in both clinical and non-clinical settings. Nucleic acids, for example, nucleic acid aptamers are promising alternatives or supplements to antibodies for this purpose. These small RNA/DNA molecules can form secondary and tertiary structures capable of specifically binding proteins or other targets. Aptamers can be developed against a seemingly unlimited range of targets such as small inorganic ions, drugs, organic peptides, proteins and even complex cells. Aptamers are thermally stable, so they can be stored and transported easily. These properties make aptamers good agents for analyte detection in a sample, protein/nucleic acid purification and other aspects of biological researches.

Methods using aptamers specific allergen proteins have been reported for detection of several common allergens, for example, gluten (PCT Publication PCT/ES2013/000133 to Amaya-Gonzalez, et al.), and toxic ß-conglutin (Lup an 1) (Nadal, et al., *PLoS ONE*, 2012, 7(4): e35253; Nadal, et al., *Anal. Bioanal. Chem.* 2013, 405: 9343-9349; and Mairal, et al., *Biosensors and Bioelectronics*, 2014, 54: 207-210.) The present inventors have recognized that allergen detection in various matrices of food products can be conveniently performed using aptamer-based detector sequences such as signaling polynucleotides (SPNs), which are particularly well suited for use in a simple and portable sensor that can be used repetitively with high sensitivity and reproducibility at ambient temperature to ensure food safety. Recent patent applications by the inventors disclose allergen specific aptamers, SPNs and their applications in allergen detection, including PCT patent application publication NO.: WO2015/066027; PCT Patent Application Serial NO.: PCT/US 16/29356; and U.S. Patent Application Ser. No. 62/308,377; the contents of each of which are incorporated by reference in their entirety.

In addition to sensitive ligands (e.g., nucleic acid aptamers) that bind analytes of interest (e.g., an allergen protein), materials and surfaces that enhance the analytic performance of the ligands and biosensors are also important. Recently A wide variety of materials including magnetic particles, gold or latex particles and electrode surfaces have been used in many settings as strategies for signaling amplification. The properties of magnetic particles, both nano- and micro-size dimensions, have proved to be promising substrates to be coupled with detection ligands for the design of cost-effective biosensing platforms.

The present application discloses magnetic particle conjugates comprising SPNs and/or SPN complexes that are suitable for allergen detection with high sensitivity and specificity. Such SPN-magnetic particle conjugates may be used as detection agents for allergen detection in a variety of analyte detection assays, kits, devices and systems.

SUMMARY OF THE INVENTION

The present invention provides signaling polynucleotides (SPNs), SPN-complement complexes, magnetic particle conjugates, DNA printed glass slides and detection agents for allergen detection, and biosensors, assays and method for detecting allergen proteins in food samples using the compositions and agents discussed in the present disclosure.

In one embodiment, SPNs derived from nucleic acid aptamers having nucleic acid sequences that bind allergens with high specificity and affinity are provided. In some aspects, the signaling polynucleotides comprise nucleic acid sequences of SEQ ID NOs.: 1-696, which bind specifically to eight common food allergens. In some aspects, the SPN comprises a nucleic acid sequence that specifically binds to cashew selected from SEQ ID NOs.: 1-12. In some aspects, the SPN may comprise a nucleic acid sequence that specifically binds to peanut selected from SEQ ID NOs.: 13-24, 96 and 97-496. In some aspects, the SPN may comprise a nucleic acid sequence that specifically binds to tree nut selected from SEQ ID NOs.: 497-696. In some aspects, the SPN may comprise a nucleic acid sequence that specifically binds to milk selected from SEQ ID NOs.: 25-34. In some aspects, the SPN may comprise a nucleic acid sequence that specifically binds to fish allergen selected from SEQ ID NOs.: 35-46. In some aspects, the SPN may comprise a nucleic acid sequence that specifically binds to egg selected from SEQ ID NOs.: 47-58 and 93-94. In some aspects, the SPN may comprise a nucleic acid sequence that specifically binds to gluten selected from SEQ ID NOs.: 59-70 and 91-92. In some aspects, the SPN may comprise a nucleic acid sequence that specifically binds to soy allergen selected from SEQ ID NOs.: 71-80. In other aspects, the SPN may comprise a nucleic acid sequence that specifically binds to crustacean selected from SEQ ID NOs.: 81-90.

In one embodiment, SPN-complement complexes are provided in accordance with the present invention. The SPN-complement complex comprises a SPN and a short nucleic acid sequence complementary to a portion of the sequence of the SPN, wherein the SPN and its corresponding complementary sequence are hybridized to form the complex. In one example, the complement is complementary to either the 5' end or 3' end sequence of the SPN. In some aspects, the complementary sequence contains about 5-20 nucleotide residues. In one preferred example, the complementary sequence contains 5-10 nucleotide residues.

In one embodiment, magnetic particle conjugates are provided in accordance with the present invention. The magnetic particle conjugates comprise SPN-complement complexes covalently immobilized on the surface of the particles. The magnetic particles may be micro-magnetic particles (MMPs) or nano-magnetic particles (NMPs). In some aspects, the 3' end of the SPN is linked to magnetic particles, for example, through a 3' amine or 3' thiol group, or the addition of a poly-A sequence at the end, or a biotin modification. In other aspects, the 5' end of the SPN is linked to magnetic particles, for example, through a 5' amine or 5' thiol group, or a biotin modification. Accordingly, the complementary sequence contains nucleotide sequences complementary to the free end of the SPN. In further other aspects, the SPN is linked to magnetic particles through its complementary sequence which is covalently immobilized on the surface of magnetic particles. In some examples, the complementary sequence may be attached to the surface of magnetic beads through amine, or thiol, or biotin-streptavidin linkage. In some aspects, magnetic particles may be further coated with PEG polymers or ethanolamine-PEG linkers.

In another embodiment. SPNs and SPN-complement complexes may be attached to the surface of a solid support; such solid support may be a glass slide, a silicon chip or wafer or a microwell plate. The DNA-printed surface may be used as a biosensing platform in a variety of settings for allergen detection. For example, a DNA printed glass slide may be inserted into a detection sensor for detection of a target allergen. In some aspects, one end of the SPN is attached to the two-dimensional surface of the solid support. The complement and allergen protein compete each other for binding to the attached SPN. In other aspects, the short complement is attached to the two-dimensional surface of the solid support. The SPN is hybridized with the complement to form complexes.

The covalent conjugation of nucleic acid molecules of the present invention (e.g., aptamer. SPN and SPN complement) to a surface, either a three-dimensional surface of magnetic particle or a two-dimensional surface of a glass slide can be through a thiol-maleimide mediated covalent chemical reaction, or an amine-mediated reaction, or a biotin-streptavidin linkage. In one example, the surface of a solid substrate (e.g. magnetic particles and glass slides) may be further coated with PEG polymers or ethanolamine-PEG linkers.

In some aspects, the nucleic acid sequence may be directly synthesized in situ on the solid substrate. In one embodiment, the short complementary oligonucleotide is directly synthesized on the solid substrate at a low density. A stable non-cleavable linker and optionally a spacer group may be used for in situ synthetic reaction.

In one embodiment, detection agents comprising SPNs, SPN-complement complexes, magnetic particle conjugates and/or DNA printed solid glasses are provided in accordance with the present invention. The detection agents may be used in any biosensor platform for capturing and detecting allergen proteins in food samples. In some aspects, the agents may be labeled with a fluorescent marker. The fluorescent marker may be conjugated to the agent in a variety of configurations. In one example, one end of the complementary sequence may be labeled with a fluorophore. In this configuration, a target allergen protein when binding to the SPN, will detach the complementary sequence hybridized with the SPN, resulting in "fluorescent signal of". In another embodiment, one end of the complementary sequence is labeled with a quencher and the free end of the SPN is labeled with a fluorophore. Therefore, the fluorescent signal is quenched in the SPN-complement complex. The binding of a target allergen will detach the complementary sequence hybridized with the SPN, resulting in the quenched fluorescent signal back on. In further another example, one end of the complementary sequence and the free end of the SPN are labeled with different fluorophores. The binding of a target allergen will detach the complementary sequence hybridized with the SPN, resulting in a change in fluorescent signal. In each signal configuration, changes in fluorescent signals can be used to determine the presence and/or absence of the target allergen in food samples.

In accordance with the present invention, kits, biosensors and devices dependent on the present compositions and agents are also provided.

In other embodiments, the present invention provides assays and methods for detecting the presence, absence and/or quantity of an allergen of interest in a sample.

BRIEF DESCRIPTION OF DRAWINGS

FIG. 1A displays a SPN linked to a magnetic particle through a thiol modification at the 5'end. FIG. 1B display a SPN linked to a magnetic particle through 3'polyA. FIG. 1C displays a SPN linked to a magnetic particle through an amine modification at the 5'end.

DETAILED DESCRIPTION OF THE INVENTION

Figure 1A:
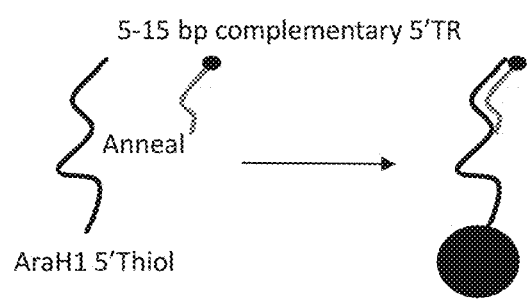
FIG. 1A, FIG. 1B and FIG. 1C illustrate configurations of detection agents comprising SPN-complement complexes and magnetic particles.

The details of one or more embodiments of the invention are set forth in the accompanying description below. Although any materials and methods similar or equivalent to those described herein can be used in the practice or testing of the present invention, the preferred materials and methods are now described. Other features, objects and advantages of the invention will be apparent from the description. In the description, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present description will control.

I. Compositions of the Present Invention

The present invention provides compositions, conjugates and detection agents for allergen detection. The functional/core component of a detection agent is a nucleic acid aptamer that specifically binds an allergen protein. In accordance with the present invention, an allergen specific aptamer may be modified to form a signal polynucleotide (SPN) (described in detail herein below). The SPN may be used as a free detection agent, or conjugated to a particle or a solid surface as a complex detection agent. In some aspects, the SPNs alone work as both binding ligands and signaling molecules or labels. In other aspects, complexes composed of SPNs and their complementary sequences work as both binding ligands and signaling molecules or labels. Aptamers, SPNs and/or SPN-complement complexes can be conjugated to any particles such as metal nanoparticles, redox compounds and magnetic particles, magnetic microparticles, and other solid surfaces such as glass slides and silicon chips, forming biosensor platforms.

Aptamers comprising nucleic acid sequences that bind common food allergens are isolated through SELEX selections. Aptamers are then modified to generate signal polynucleotides (SPNs) which work as capturing and detecting ligands for allergen proteins. In particular, the SPN may comprise a nucleic acid sequence selected from SEQ ID NOs.: 1-696.

In some aspects, the SPN comprises a nucleic acid sequence that specifically binds to cashew selected from SEQ ID NOs.: 1-12; the cashew specific SPN has a unique sequence of SEQ ID. NOs.: 1-6. In some aspects, the SPN may comprise a nucleic acid sequence that specifically binds to peanut selected from SEQ ID NOs.: 13-24, and 96-696; the peanut specific SPN has a unique sequence of SEQ ID NOs.: 13-18 and 97-296. In some aspects, the SPN may comprise a nucleic acid sequence that specifically binds to tree nut selected from SEQ ID NOs.: 497-696; the tree nut specific SPN has a unique sequence of SEQ ID NOs.: 497-596. In some aspects, the SPN may comprise a nucleic acid sequence that specifically binds to milk selected from SEQ ID NOs.: 25-34; the milk specific SPN has a unique sequence of SEQ ID NOs.: 25-29. In some aspects, the SPN may comprise a nucleic acid sequence that specifically binds to fish allergen selected from SEQ ID NOs.: 35-46; the fish specific SPN has a unique sequence of SEQ ID NOs.: 35-40. In some aspects, the SPN may comprise a nucleic acid sequence that specifically binds to egg selected from SEQ ID NOs.: 47-58 and 93-94; the egg specific SPN has a unique sequence of SEQ ID NOs.: 47-52. In some aspects, the SPN may comprise a nucleic acid sequence that specifically binds to gluten selected from SEQ ID NOs.: 59-70 and 91-92, the gluten specific SPN has a unique sequence of SEQ ID NOs.: 59-64. In some aspects, the SPN may comprise a nucleic acid sequence that specifically binds to soy allergen selected from SEQ ID NOs.: 71-80; the soy specific SPN has a unique sequence of SEQ ID NOs.: 71-75. In other aspects, the SPN may comprise a nucleic acid sequence that specifically binds to crustacean selected from SEQ ID NOs.: 81-90; the crustacean specific SPN has a unique sequence of SEQ ID NOs.: 81-85.

In some embodiments, a SPN and a short nucleic acid sequence which is complementary to a portion of the sequence of the SPN (e.g., the sequence at either the 5' end or 3' end of the SPN) may be hybridized to form a complex (referred to "SPN-complement complex"). The SPN-complement complexes may be attached to the surface of magnetic particles or other solid surfaces through either the SPN or the complementary sequence.

In some embodiments, SPNs of the present invention are conjugated to the surface of magnetic particles or a solid substrate (e.g., a glass slide) at one end, e.g. the 5' end or 3'end (e.g., as shown in FIGS. 4A, 4B and 4C and FIG. 5A). Nucleic acid molecules can be covalently attached to magnetic particles/beads by methods based on the formation of covalent bonds. Carboxyl and amino groups are the most common reactive groups for attaching ligands to surfaces. In some aspects, a primary amine (—NH2) modifier may be placed to the 5'end, or 3'end of a nucleic acid molecule (e.g., SPN), or internally using an amino-C or amino-T modified base. The amino-modified nucleic acid molecules may be attached to magnetic particles using an acylating reagent, for example Carbodiimide (EDC). In other aspects, a thiol group (—SH) may be attached to the 5' or 3' end of a nucleic acid molecule (e.g., a SPN). The thiol (—SH) modifier enables covalent attachment of a nucleic acid molecule to a variety of substrates including magnetic particles, via disulfide bond (—S—S—) or maleimide linkages. In another example, a biotinylated SPN may be conjugated to streptavidin-coated magnetic particles. In another example, PEG polymers may be introduced to the surface of a solid substrate before the conjugation.

Figure 5A:
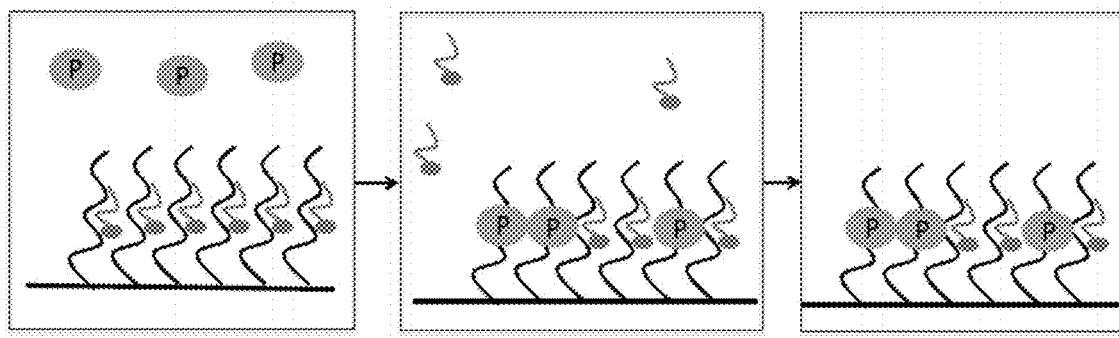
FIG. 5A illustrates a diagram of SPN-complement complexes conjugated to the surface of a solid substrate through one end of the SPN for exposing allergen proteins.

In this context, the opposite end of the SPN which is free from the attached magnetic particles may be hybridized with the complementary sequence, forming a SPN-complement complex. The short complementary sequences may be labeled with a fluorescent dye, such as Alex 647, Cy5, Cy3-FITC and Texas red. The binding of an allergen to the SPN will detach the complementary sequence from the complex, resulting in a signaling change (as shown in FIG. 5A).

Figure 5B:
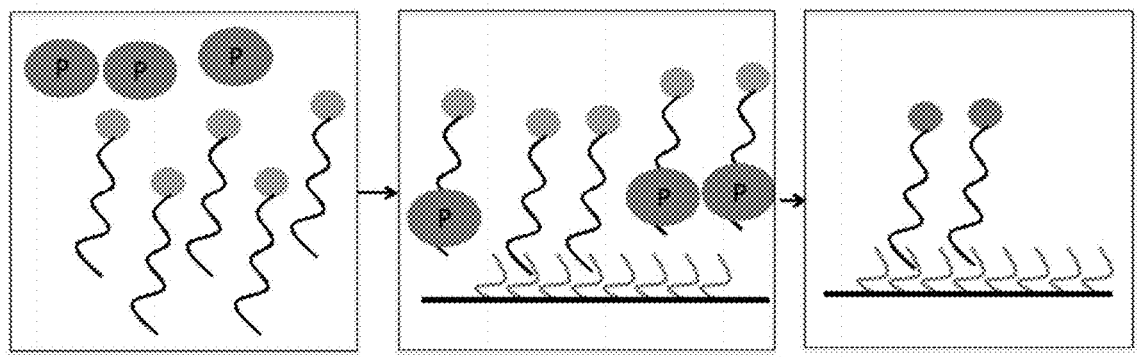
FIG. 5B displays a diagram of a complementary sequence conjugated to the surface of a solid substrate for exposing the SPN-allergen complexes.
Figure 6A:
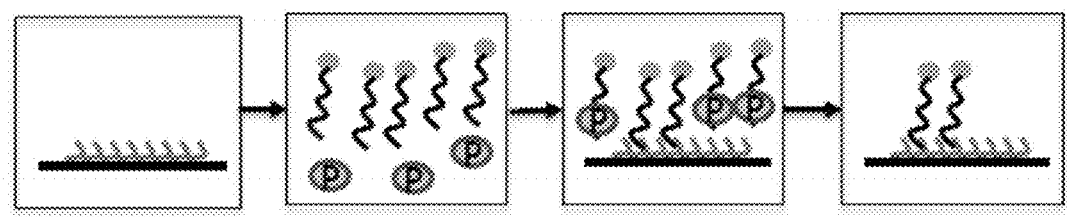
FIG. 6A demonstrates an attachment assay using the complementary sequence printed glass slide. The SPNs and their allergen proteins are premixed and form SPN-protein complexes. The free SPNs and SPN-protein complexes will compete with each other to attach to the complementary sequences on the surface.
Figure 6B:
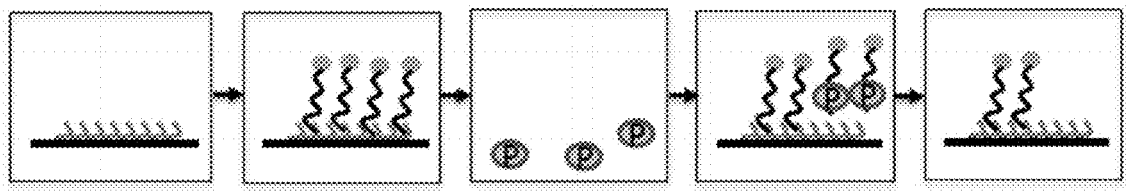
FIG. 6B demonstrates a detachment assay. The SPNs are first hybridized with the complementary sequences on the surface, forming SPN-complement complexes. Allergen proteins are added and bind to the SPNs. The SPN-protein complexes detach from the surface and will be washed off.

In some embodiments, the complementary sequences of the SPNs may be conjugated to the surface of magnetic particles or other solid substrates (e.g., printed glass surface) through covalent bindings as discussed herein. In this context, the printed glass surface having such complementary sequences may be exposed to the SPNs and allergen proteins. In this context, either an attachment assay or detachment assay may be developed for detection of allergen proteins (FIG. 6A and FIG. 6B). For example, in the attachment assay, the SPNs and allergen proteins are pre-mixed before being exposed to the complementary sequences. Only the free SPNs will bind to the complements (FIG. 5B and FIG. 6A), generating fluorescent signals from the fluorescent dye at either the 5'end or 3'end of the SPN. As non-limiting examples, the fluorophore may be selected from Alex Fluor® fluorophores (such as Alex 514, Alex 532, Alex 546, Alex 555, Alex 568, Alex 594, Alex 610, Alex 633, Alex 635, Alex 647, Alex 660, Alex 680, Alexa 700, Alex 750, Alex 800, Alex 610-R-phycoerythrin (R-PE), Alex 647-R-phycoerythrin (R-PE), Alex 680-R-phycoerythrin (R-PE), and Alex 680-Allophycocyanin (APC)), Allophycocyanin (APC) and its derivatives, Cy fluorophores (e.g., Cy3.5, Cy3-FITC, CY5, CY 5.5, CY7, CY7-APC, CY5.5-APC), Qdots, TRITC, R-PE, Tamara, Rhodamine Red-X, Rox, TruRed, SYPRO red, BODIPY TR, Propidium iodide and Texas red. In some examples, the fluorescent dye is Alex 647, Cy5, CY3-FITC or Texas red.

In other embodiments, nucleic acid molecules of the present invention may be attached to solid surfaces by in situ oligonucleotide synthesis.

Aptamers, Signaling Polynucleotides (SPNs) and SPN-Complement Complex

Aptamers (sometimes also called chemical antibodies) are single-stranded oligonucleotides (RNA or single stranded DNA) that form stable but unique three-dimensional confirmations capable of binding with high affinity and specificity to a variety of molecular targets. Aptamers bind to protein targets in much the same manner as antibodies and modulate protein function. Thus, aptamers are also referred to as "chemical antibodies". Aptamers have advantages over antibodies in that they are poorly immunogenic, stable, and often bind to a target molecule more strongly than do antibodies. Generally aptamers can be synthesized easily and in large quantities by in vitro transcription, PCR, or chemical synthesis (*Annu. Rev. Med.* 2005, 56, 555-583; *Nat. Rev. Drug Discov.* 2006, 5, 123-132), and target-specific aptamers can be selected from random-sequence, single-stranded nucleic acid libraries by an in vitro selection and amplification procedure known as SELEX (systematic evolution of ligands by exponential enrichment). The selected aptamers are small single-stranded nucleic acids that fold into a well-defined three-dimensional structure. They show a high affinity and specificity for their target molecules and inhibit their biological functions. Furthermore, aptamers have important properties that simplify its industrialization. For example, aptamers are thermally stable, so they can be stored and transported easily. Aptamers can be produced or modified in large scale, with minimal batch-to-batch variation, given the well-established chemical synthesis and modification technologies.

Aptamers are useful and cost-effective tools for biochemical analyses. Also, they can be developed quickly against a seemingly unlimited range of targets. To date, specific aptamers against diverse targets have been successfully developed, including small inorganic irons, organic peptides, drugs, proteins, lipids and even complex cells. One of the more recent reviews of aptamer-based analysis in context of food safety control indicated that the selection of aptamers for this group of ingredients is emerging (Amaya-Gonzalez et al., *Sensors* 2013, 13: 16292-16311, the contents of which are incorporated herein by reference in its entirety).

1. Selection of Aptamers Specific to a Target

Aptamers can be artificially generated by a method called systematic evolution of ligands by exponential enrichment (SELEX) (Tuerk and Gold, *Science,* 1990, 249, 505-510). More recently, a new improved separation technology for aptamer selection was introduced, capillary electrophoresis (CE)-SELEX (Mosing and Bowser, *Methods Mol Biol.,* 2009, 535: 33-43).

Aptamers that bind to virtually any particular target can be selected by using an iterative process called SELEX™ (Systemic Evolution of Ligands by Exponential Enrichment). The process is described in, for example U.S. Pat. Nos. 5,270,163 and 5,475,096. The SELEX™ process is based on the unique insight that nucleic acids have sufficient capacity for forming a variety of two- and three-dimensional structures and sufficient chemical versatility available within their monomers to act as ligands (i.e., form specific binding pairs) with virtually any chemical compound, whether monomeric or polymeric.

The SELEX™ process relies, as a starting point, upon a large library or pool of single stranded oligonucleotides comprising randomized sequences. The oligonucleotides can be modified or unmodified DNA, RNA, or DNA/RNA hybrids. In some examples, the pool comprises 100% random or partially random oligonucleotides. In other examples, the pool comprises random or partially random oligonucleotides containing at least one fixed sequence and/or conserved sequence incorporated within randomized sequence. In other examples, the pool comprises random or partially random oligonucleotides containing at least one fixed sequence and/or conserved sequence at its 5' and/or 3' end which may comprise a sequence shared by all the molecules of the oligonucleotide pool. Fixed sequences are sequences common to oligonucleotides in the pool which are incorporated for a preselected purpose such as, CpG motifs, hybridization sites for PCR primers, promoter sequences for RNA polymerases (e.g., T3, T4, T7, and SP6), restriction sites, or homopolymeric sequences, such as poly A or poly T tracts, catalytic cores, sites for selective binding to affinity columns, and other sequences to facilitate cloning and/or sequencing of an oligonucleotide of interest. Conserved sequences are sequences, other than the previously described fixed sequences, shared by a number of aptamers that bind to the same target.

The oligonucleotides of the pool preferably include a randomized sequence portion as well as fixed sequences necessary for efficient amplification. Typically, the oligonucleotides of the starting pool contain fixed 5' and 3' terminal sequences which flank an internal region of 30-50 random nucleotides. The randomized nucleotides can be produced in a number of ways including chemical synthesis and size selection from randomly cleaved cellular nucleic acids. Sequence variation in the test nucleic acids can also be introduced or increased by mutagenesis before or during the selection/amplification iterations.

The random sequence portion of the oligonucleotide can be of any length and can comprise ribonucleotides and/or deoxyribonucleotides and can include modified or non-natural nucleotides or nucleotide analogs (see for example U.S. Pat. Nos. 5,958,691 and 5,660,985). Random oligonucleotides can be synthesized from phosphodiester-linked nucleotides using solid phase oligonucleotide synthesis techniques well known in the art. Random oligonucleotides can also be synthesized using solution phase methods such as triester synthesis methods. Typical syntheses carried out on automated DNA synthesis equipment yield $10^{14}$-$10^{16}$ individual molecules, a number sufficient for most SELEX™ experiments.

The starting library of oligonucleotides may be generated by automated chemical synthesis on a DNA synthesizer. Partially random sequences can be created by adding the four nucleotides in different molar ratios at each addition step.

The library of oligonucleotides for aptamer selection may be either RNA or DNA. A RNA library of oligonucleotides is typically generated by transcribing a DNA library of oligonucleotides in vitro using T7 RNA polymerase or modified T7 RNA polymerases and purified. The RNA or DNA library is then mixed with the target under conditions favorable for binding and subjected to step-wise iterations of binding, partitioning and amplification, using the same general selection scheme, to achieve the desired criterion of binding affinity and selectivity as defined in the present application.

More specifically, starting with a mixture containing the starting pool of nucleic acids, the SELEX™ method includes steps of: (a) contacting the mixture with the target under conditions favorable for binding; (b) partitioning unbound nucleic acids from those nucleic acids which have bound specifically to target molecules; (c) dissociating the nucleic acid-target complexes; (d) amplifying the nucleic acids dissociated from the nucleic acid-target complexes to yield a ligand-enriched mixture of nucleic acids; and (e) reiterating the steps of binding, partitioning, dissociating and amplifying through as many cycles as desired to yield highly specific, high affinity nucleic acid ligands to the target molecule. Cycles of selection and amplification are repeated until a desired goal is achieved. Generally this is until no significant improvement in binding strength is achieved on repetition of the cycle. Typically, nucleic acid aptamer molecules are selected in a 5 to 20 cycle procedure.

A variety of nucleic acid primary, secondary and tertiary structures are known to exist. The structures or motifs that have been shown most commonly to be involved in non-Watson-Crick type interactions are referred to as hairpin loops, symmetric and asymmetric bulges, pseudoknots and myriad combinations of the same. The core SELEX™ method has been modified to achieve a number of specific objectives, such as selection of aptamers with particular secondary structures. Examples of SELEX processes can be found in U.S. Pat. Nos. 5,270,163 and 5,475,096. For example, U.S. Pat. No. 5,707,796 describes the use of SELEX™ in conjunction with gel electrophoresis to select nucleic acid molecules with specific structural characteristics, such as bent DNA. U.S. Pat. No. 5,763,177 describes SELEX™ based methods for selecting nucleic acid ligands containing photo reactive groups capable of binding and/or photo-crosslinking to and/or photo-inactivating a target molecule. U.S. Pat. Nos. 5,567,588 and 5,861,254 describe SELEX™ based methods which achieve highly efficient partitioning between oligonucleotides having high and low affinity for a target molecule. U.S. Pat. No. 5,496,938 describes methods for obtaining improved nucleic acid ligands after the SELEX™ process has been performed. U.S. Pat. No. 5,705,337 describes methods for covalently linking a ligand to its target, the contents of each of which are incorporated herein by reference in their entirety.

Counter-SELEX™ is a method for improving the specificity of nucleic acid ligands to a target molecule by eliminating nucleic acid ligand sequences with cross-reactivity to one or more non-target molecules. Counter-SELEX™ is comprised of the steps of: (a) preparing a candidate mixture of nucleic acids; (b) contacting the candidate mixture with the target, wherein nucleic acids having an increased affinity to the target relative to the candidate mixture may be partitioned from the remainder of the candidate mixture; (c) partitioning the increased affinity nucleic acids from the remainder of the candidate mixture; (d) dissociating the increased affinity nucleic acids from the target; (e) contacting the increased affinity nucleic acids with one or more non-target molecules such that nucleic acid ligands with specific affinity for the non-target molecule(s) are removed; and (f) amplifying the nucleic acids with specific affinity only to the target molecule to yield a mixture of nucleic acids enriched for nucleic acid sequences with a relatively higher affinity and specificity for binding to the target molecule. As described above for SELEX™, cycles of selection and amplification are repeated as necessary until a desired goal is achieved.

The binding affinity describes the measure of the strength of the binding or affinity of molecules to each other. Binding affinity of the aptamer herein with respect to targets and other molecules is defined in terms of $K_d$. The dissociation constant can be determined by methods known in the art. It has been observed, however, that for some small oligonucleotides, direct determination of $K_d$ is difficult, and can lead to misleadingly high results. Under these circumstances, a competitive binding assay for the target molecule or other candidate substance can be conducted with respect to substances known to bind the target or candidate. The value of the concentration at which 50% inhibition occurs ($K_i$) is, under ideal conditions, equivalent to $K_d$.

In accordance with the present invention, a SELEX approach was used to select core binding aptamers that bind 8 major food allergens (i.e. cashew, egg, milk, peanuts, gluten, fish, crustacean and soy). Several aptamers with sequences that can specifically recognize a target allergen were selected and the nucleic acid sequences of selected aptamers were further modified to generate signaling polynucleotides. The aptamers with high selectivity, specificity and stability are selected and further labeled as detection agents. The sequences of the selected aptamers for the 8 major allergens are listed in Table 1. For example, an aptamer having a full sequence (SEQ ID NO.: 7) is one of the SPNs that bind cashew. The full sequence includes the primers used for the screen and the core binding sequence of the aptamer (SEQ ID NO.: 1), the full sequence will be further modified to generate signaling polynucleotides (SPNs) specific to cashew, as discussed herein below.

2. Aptamer Modifications

In accordance with the present invention, oligonucleotides and aptamers may be further modified to improve their stability. The present invention also includes analogs as described herein and/or additional modifications designed to improve one or more characteristics of aptamers such as protection from nuclease digestion. Oligonucleotide modifications contemplated in the present invention include, but are not limited to, those which provide other chemical groups that incorporate additional charge, polarizability, hydrophobicity, hydrogen bonding, electrostatic interaction, and fluxionality to the nucleic acid ligand bases or to the nucleic acid ligand as a whole.

Modifications to generate oligonucleotides which are resistant to nucleases can also include one or more substitute internucleotide linkages, altered sugars, altered bases, or combinations thereof. Such modifications include 2'-position sugar modifications, 5-position pyrimidine modifications, 8-position purine modifications, modifications at exocyclic amines, substitution of 4-thiouridine, substitution of 5-bromo or 5-iodo-uracil, backbone modifications, phosphorothioate or alkyl phosphate modifications, methylations, and unusual base-pairing combinations such as the isobases isocytidine and isoguanosine, 3' and 5' modifications such as capping; conjugation to a high molecular weight, non-immunogenic compound; conjugation to a lipophilic compound; and phosphate backbone modification.

Nucleic acid aptamers may be ribonucleic acid, deoxyribonucleic acid, or mixed ribonucleic acid and deoxyribonucleic acid. Aptamers may be single stranded ribonucleic acid, deoxyribonucleic acid or mixed ribonucleic acid and deoxyribonucleic acid.

Nucleic acid aptamers comprise a series of linked nucleosides or nucleotides. The term "nucleic acid," in its broadest sense, includes any compound and/or substance that comprise a polymer of nucleotides. These polymers are often referred to as polynucleotides. Exemplary nucleic acid molecules or polynucleotides of the invention include, but are not limited to, either D- or L-nucleic acids, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure, the ribofuranosyl ring or in the ribose-phosphate backbone.

In some embodiments, the aptamer comprises at least one chemical modification. In some embodiments, the chemical modification is selected from a chemical substitution of the nucleic acid at a sugar position, a chemical substitution at a phosphate position and a chemical substitution at a base position. In other embodiments, the chemical modification is selected from incorporation of a modified nucleotide; 3' capping; conjugation to a high molecular weight, non-immunogenic compound; conjugation to a lipophilic compound; and incorporation of phosphorothioate into the phosphate backbone. In a preferred embodiment, the high molecular weight, non-immunogenic compound is polyalkylene glycol, and more preferably is polyethylene glycol (PEG). The process of covalent conjugation of PEG to another molecule, normally a drug or therapeutic protein is known as PEGylation. PEGylation is routinely achieved by incubation of a reactive derivative of PEG with the target molecule. The covalent attachment of PEG to a drug or therapeutic protein can mask the agent from the host's immune system, thereby providing reduced immunogenicity and antigenicity, and increase the hydrodynamic size (size in solution) of the agent which prolongs its circulatory time by reducing renal clearance. PEGylation can also provide water solubility to hydrophobic drugs and proteins.

In another preferred embodiment, the 3' cap is an inverted deoxythymidine cap.

In some embodiments, nucleic acid aptamers are provided in which the P(O)O group is replaced by P(O)S ("thioate"), P(S)S ("dithioate"), P(O)NR2 ("amidate"), P(O)R, P(O) OR', CO or CH2 ("formacetal") or 3'-amine (—NH—CH2—CH2-), wherein each R or R' is independently H or substituted or unsubstituted alkyl. Linkage groups can be attached to adjacent nucleotide through a —O—, —N—, or —S— linkage. Not all linkages in the nucleic acid aptamers are required to be identical.

As non-limiting examples, a nucleic acid aptamer can include D-ribose or L-ribose nucleic acid residues and can also include at least one modified ribonucleoside including but not limited to a 2'-O-methyl modified nucleoside, a nucleoside comprising a 5' phosphorothioate group, a terminal nucleoside linked to a cholesteryl derivative or dodecanoic acid bisdecylamide group, a locked nucleoside, an abasic nucleoside, an inverted deoxynucleoside or inverted ribonucleoside, a 2'-deoxy-2'-fluoro-modified nucleoside, a 2'-amino-modified nucleoside, a 2'-alkyl-modified nucleoside, a morpholino nucleoside, a phosphoramidate or a non-natural base comprising nucleoside, or any combination thereof. Alternatively, a nucleic acid aptamer can comprise at least two modified ribonucleosides, at least 3, at least 4, at least 5, at least 6, at least 7, at least 8, at least 9, at least 10, at least 15, at least 20 or more modified ribonucleosides, up to the entire length of the molecule. The modifications need not be the same for each of such a plurality of modified deoxy- or ribonucleosides in a nucleic acid molecule.

Aptamer may comprise modified nucleobase (often referred to in the art simply as "base") for increasing the affinity and specificity for their target protein. As used herein, "unmodified" or "natural" nucleobases include the purine bases adenine (A) and guanine (G), and the pyrimidine bases thymine (T), cytosine (C) and uracil (U). For example, the modified base may be a pyrimidine modified by a hydrophobic group, such as benzyl group, a naphthyl group, or a pyrrolebenzyl group, at its 5-position. Modified nucleoside may be exemplified as 5-(N-benzylcarboxyamide)-2'-deoxyuridine (called BzdU), 5-(N-naphthylcarboxyamide)-2'-deoxyuridine (called NapdU), 5-(N-4-pyrrolebenzyl carboxyamide)-2'-deoxyuridine (called 4-PBdU), 5-(N-benzylcarboxyamide)-2'-deoxycytidine (called BzdC), 5-(N-naphthylcarboxyamide)-2'-deoxycytidine (called NapdC), 5-(N-4-pyrrolebenzylcarboxyamide)-2'-deoxycytidine (called 4-PBdC), 5-(N-benzylcarboxyamide)-2'-uridine (called BzU), 5-(N-naphthylcarboxyamide)-2'-uridine (called NapU), 5-(N-4-pyrrolebenzylcarboxyamide)-2'-uridine (called 4-PBU), 5-(N-benzylcarboxyamide)-2'-cytidine (called BzC), 5-(N-naphthylcarboxyamide)-2'-cytidine (called NapC), 5-(N-4-pyrrolebenzyl carboxyamide)-2'-cytidine (called 4-PBC), and the like, but not be limited thereto. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, those disclosed by Englisch et al., *Angewandte Chemie*, International Edition, 1991, 30, 613, and those disclosed by Sanghvi, Y S., Chapter 15, *dsRNA Research and Applications*, pages 289-302, Crooke, S. T. and Lebleu, B., Ed., CRC Press, 1993.

In accordance with the present invention, a suitable nucleotide length for an aptamer ranges from about 15 to about 100 nucleotides (nt), and in various other preferred embodiments, 15-30 nt, 20-25 nt, 30-100 nt, 30-60 nt, 25-70 nt, 25-60 nt, 40-60 nt, 25-40 nt, 30-40 nt, any of 18, 19, 20, 21, 22, 23, 24, 25, 26, 27, 28, 29, 30, 31, 32, 33, 34, 35, 36, 37, 38, 39 or 40 nt or 40-70 nt in length. In some embodiments, an aptamer may be 41, 42, 43, 44, 45, 46, 47, 48, 49, 50, 51, 52, 53, 54, 55, 56, 57, 58, 59, 60, 61, 62, 63, 64, 65, 66, 67, 68, 69, or 70 nt in length. In other embodiments, an aptamer may 71, 72, 73, 74, 75, 76, 77, 78, 79, 80, 81, 82, 83, 84, 85, 86, 87, 88, 89, 90, 91, 92, 93, 94, 95, 96, 97, 98, 99 or 100 nt in length. However, the sequence can be designed with sufficient flexibility such that it can accommodate interactions of aptamers with two targets at the distances described herein.

In some embodiments, the nucleic acid aptamer comprises one or more regions of double-stranded character. Such double stranded regions may arise from internal self-complementarity or complementarity with a second or further aptamers or oligonucleotide molecule. In some embodiments the double stranded region may be from 4-12, 4-10, 4-8 base pairs in length. In some embodiments the double stranded region may be 5, 6, 7, 8, 9, 10, 11 or 12 base pairs. In some embodiments the double stranded region may form a stem region. Such extended stem regions having double stranded character can serve to stabilize the nucleic acid aptamer. As used herein, the term "double stranded character" means that over any length of two nucleic acid molecules, their sequences form base pairings (standard or nonstandard) of more than 50 percent of the length.

Aptamers may be further modified to provide protection from nuclease and other enzymatic activities. The aptamer sequence can be modified by any suitable methods known in the art. For example, phosphorothioate can be incorporated into the backbone, and 5'-modified pyrimidine can be included in 5' end of ssDNA for DNA aptamers. For RNA aptamers, modified nucleotides such as substitutions of the 2'-OH groups of the ribose backbone, e.g., with 2'-deoxy-NTP or 2'-fluoro-NTP, can be incorporated into the RNA molecule using T7 RNA polymerase mutants. The resistance of these modified aptamers to nuclease can be tested by incubating them with either purified nucleases or nuclease from mouse serum, and the integrity of aptamers can be analyzed by gel electrophoresis.

In some embodiments, such modified nucleic acid aptamers may be synthesized entirely of modified nucleotides, or with a subset of modified nucleotides. The modifications can be the same or different. All nucleotides may be modified, and all may contain the same modification. All nucleotides may be modified, but contain different modifications, e.g., all nucleotides containing the same base may have one type of modification, while nucleotides containing other bases may have different types of modifications. For example, all purine nucleotides may have one type of modification (or are unmodified), while all pyrimidine nucleotides have another, different type of modification (or are unmodified). In this way, oligonucleotides, or libraries of oligonucleotides are generated using any combination of modifications as disclosed herein.

Aptamers may be either monovalent or multivalent. Aptamers may be monomeric, dimeric, trimeric, tetrameric or higher multimeric. Individual aptamer monomers may be linked to form multimeric aptamer fusion molecules. As a non-limiting example, a linking oligonucleotide (i.e., linker) may be designed to contain sequences complementary to both 5'-arm and 3'-arm regions of random aptamers to form dimeric aptamers. For trimeric or tetrameric aptamers, a small trimeric or tetrameric (i.e., a Holiday junction-like) DNA nanostructure will be engineered to include sequences complementary to the 3'-arm region of the random aptamers, therefore creating multimeric aptamer fusion through hybridization. In addition, 3 to 5 or 5 to 10 dT rich nucleotides can be engineered into the linker polynucleotides as a single stranded region between the aptamer-binding motifs, which offers flexibility and freedom of multiple aptamers to coordinate and synergize multivalent interactions with cellular ligands or receptors. Alternatively, multimeric aptamers can also be formed by mixing biotinylated aptamers with streptavidin.

As used herein, the term "multimeric aptamer" or "multivalent aptamer" refers to an aptamer that comprises multiple monomeric units, wherein each of the monomeric units can be an aptamer on its own. Multivalent aptamers have multivalent binding characteristics. A multimeric aptamer can be a homomultimer or a heteromultimer. The term "homomultimer" refers to a multimeric aptamer that comprises multiple binding units of the same kind, i.e., each unit binds to the same binding site of the same target molecule. The term "heteromultimer" refers to a multimeric aptamer that comprises multiple binding units of different kinds, i.e., each binding unit binds to a different binding site of the same target molecule, or each binding unit binds to a binding site on different target molecule. Thus, a heteromultimer can refer to a multimeric aptamer that binds to one target molecule at different binding sties or a multimeric aptamer that binds to different target molecules. A heteromultimer that binds to different target molecules can also be referred to as a multi-specific multimer.

According to certain embodiments of the present invention, variants and derivatives of aptamers are provided. The term "derivative" is used synonymously with the term "variant" and refers to a molecule that has been modified or changed in any way relative to a reference or starting aptamer. The nucleic acid sequence of aptamer variants may possess substitutions, deletions, and/or insertions at certain positions within the nucleotide sequence, as compared to a reference or starting sequence. Ordinarily, variants will possess at least about 50% identity (homology) to a reference sequence, and preferably, they will be at least about 80%, more preferably at least about 90% identical (homologous) to a reference sequence.

In some embodiments, variant mimics of aptamers of the present invention are provided. As used herein, the term "variant mimic" is one which contains one or more nucleic acids which would mimic an activated sequence. The nucleic acid sequences of variant mimics may comprise naturally occurring nucleic acids, or alternatively, non-naturally occurring nucleic acids.

3. Signaling Polynucleotides (SPNs)

Aptamers selected through the process mentioned above herein may be used as signaling polynucleotides (SPNs) for detection of target allergens. Signaling polynucleotides based on aptamer core/binding sequences are advantageous with respect to the objective of development of simple, yet effective detection assays for biomolecule sensors. In accordance with the present invention, a signaling polynucleotide may be developed from the selected aptamers which specifically bind a target allergen molecule. The polynucleotide sequences are detectable when bound at high affinity and specificity to molecular targets.

In some embodiments, signaling polynucleotides (SPNs) of the present invention comprise the core binding sequences which determine the specificity and affinity of SPNs to a target allergen molecule. The full sequence of a selected aptamer can be shortened by deleting the primers used for aptamer selection without impacting the binding sequence to a target allergen. Additional nucleotides may also be added at the 5'terminus and/or the 3' terminus, without impacting the binding (core) sequence of each aptamer. 3D structures of such SPNs are predicted using standard structure prediction software. The resulting polynucleotide may form a stable 3D structure. In other aspects, nucleotides added at the termini may increase the stability of the polynucleotide and facilitate magnetic particle conjugation, and/or other modifications. For example, a short polyA sequence may be added to the terminus of a SPN to increase the distance between the SPN and magnetic particles (or other solid surface). The length and sequence of additional nucleotides may vary in the context of the core binding sequence of a signaling polynucleotide. SPNs generated from aptamers against common allergens are listed in Tables 1-4.

In some aspects, the SPN comprises a nucleic acid sequence that specifically binds to cashew selected from SEQ ID NOs.: 1-12; the cashew specific SPN has a unique sequence of SEQ ID. NOs.: 1-6. In some aspects, the SPN may comprise a nucleic acid sequence that specifically binds to peanut selected from SEQ ID NOs.: 13-24, and 97-496; the peanut specific SPN has a unique sequence of SEQ ID NOs.: 13-18 and 97-296. In some aspects, the SPN may comprise a nucleic acid sequence that specifically binds to tree nut selected from SEQ ID NOs.: 497-696; the tree nut specific SPN has a unique sequence of SEQ ID NOs.: 497-596. In some aspects, the SPN may comprise a nucleic acid sequence that specifically binds to milk selected from SEQ ID NOs.: 25-34; the milk specific SPN has a unique sequence of SEQ ID NOs.: 25-29. In some aspects, the SPN may comprise a nucleic acid sequence that specifically binds to fish allergen selected from SEQ ID NOs.: 35-46; the fish specific SPN has a unique sequence of SEQ ID NOs.: 35-40. In some aspects, the SPN may comprise a nucleic acid sequence that specifically binds to egg selected from SEQ ID NOs.: 47-58 and 93-94; the egg specific SPN has a unique sequence of SEQ ID NOs.: 47-52. In some aspects, the SPN may comprise a nucleic acid sequence that specifically binds to gluten selected from SEQ ID NOs.: 59-70 and 91-92; the gluten specific SPN has a unique sequence of SEQ ID NOs.: 59-64. In some aspects, the SPN may comprise a nucleic acid sequence that specifically binds to soy allergen selected from SEQ ID NOs.: 71-80; the soy specific SPN has a unique sequence of SEQ ID NOs.: 71-75. In other aspects, the SPN may comprise a nucleic acid sequence that specifically binds to crustacean selected from SEQ ID NOs.: 81-90; the crustacean specific SPN has a unique sequence of SEQ ID NOs.: 81-85.

TABLE 1

Aptamers and SPNs that bind common allergens

| SEQ ID NO. | Core sequence (5'-3') | SEQ ID NO. | Full Sequence (5'-3') |
|---|---|---|---|
| Cashew ||||
| 1 | GCACACCACGTCAAAAATCATTGTCACC ACGAAGC | 7 | TAATACGACTCACTATAGGCGTAGCCTGATGAGGC ACACCACGTCAAAAATCATTGTCACCACGAAGCCG AAACGTGGTGAAAGCCACGTAGCTGCGCC |

TABLE 1-continued

Aptamers and SPNs that bind common allergens

| SEQ ID NO. | Core sequence (5'-3') | SEQ ID NO. | Full Sequence (5'-3') |
|---|---|---|---|
| 2 | TGCGCAACATAAGTCTCTTGAAAGACCACGTTCAA | 8 | TAATACGACTCACTATAGGCGTAGCCTGATGAGTGCGCAACATAAGTCTCTTGAAAGACCACGTTCAACGAAACGTGGTGAAAGCCACGTAGCTGCGCC |
| 3 | CACCCACCATACCAGAAATGTTGACACCACGTGGA | 9 | TAATACGACTCACTATAGGCGTAGCCTGATGAGCACCCACCATACCAGAAATGTTGACACCACGTGGACGAAACGTGGTGAAAGCCACGTAGCTGCGCC |
| 4 | TGCACAATGTAATTATCAAAATACACCACGGTTGC | 10 | TAATACGACTCACTATAGGCGTAGCCTGATGAGTGCACAATGTAATTATCAAAATACACCACGTTGGCCGAAACGTGGTGAAAGCCACGTAGCTGCGCC |
| 5 | CCACATCGTGCAATGCCCGAAACATACCACGTAGA | 11 | TAATACGACTCACTATAGGCGTAGCCTGATGAGCCACATCGTGCAATGCCCGAAACATACCACGTAGACGAAACGTGGTGAAAGCCACGTAGCTGCGCC |
| 6 | CTATGCAGTGATGATTAAAGATACCACCACGTGAG | 12 | TAATACGACTCACTATAGGCGTAGCCTGATGAGCTATGCAGTGATGATTAAAGATACCACCACGTGAGCGAAACGTGGTGAAAGCCACGTAGCTGCGCC |

Peanut

| SEQ ID NO. | Core sequence (5'-3') | SEQ ID NO. | Full Sequence (5'-3') |
|---|---|---|---|
| 13 | CAAATAGTTACAAACACCACGTAG | 19 | TAATACGACTCACTATAGGCGTAGCCTGATGAGCAAATAGTTACAAACACCACGTAGCGAAACGTGGTGAAGCCACGTAGCTGCGCC |
| 14 | CCCAACTGTACAGTACACCACGTAG | 20 | TAATACGACTCACTATAGGCGTAGCCTGATGAGCCCAACTGTACAGTACACCACGTAGCGAAACGTGGTGAAAGCCACGTAGCTGCGCC |
| 15 | CACACACACATTCCACCACGTCACG | 21 | TAATACGACTCACTATAGGCGTAGCCTGATGAGCACACACACATTCCACCACGTCACGCGAAACGTGGTGAAAGCCACGTAGCTGCGCC |
| 16 | CACACGTTACCACACCACGTTGACG | 22 | TAATACGACTCACTATAGGCGTAGCCTGATGAGCACACGTTACCACACCACGTTGACGCGAAACGTGGTGAAAGCCACGTAGCTGCGCC |
| 17 | CGTGCCCGAAACACACACCACGATG | 23 | TAATACGACTCACTATAGGCGTAGCCTGATGAGCGTGCCCGAAACACACACCACGATGCGAAACGTGGTGAAAGCCACGTAGCTGCGCC |
| 18 | CTCACCACATACCATGTACCACGTG | 24 | TAATACGACTCACTATAGGCGTAGCCTGATGAGCTCACCACATACCATGTACCACGTGCGAAACGTGGTGAAAGCCACGTAGCTGCGCC |

Milk

| SEQ ID NO. | Core sequence (5'-3') | SEQ ID NO. | Full Sequence (5'-3') |
|---|---|---|---|
| 25 | TTCACTGGCTGCACCCACCACCGCGTTCCA | 30 | TAATACGACTCACTATAGGCGTAGCCTGATGAGTTCACTGGCTGCACCCACCACCGCGTTCCACGAAACGTGGTGAAAGCCACGTAGCTGCGCC |
| 26 | CATCCACGGTGACGCTAATCCCACGTTCGA | 31 | TAATACGACTCACTATAGGCGTAGCCTGATGAGCATCCACGGTGACGCTAATCCCACGTTCGACGAAACGTGGTGAAAGCCACGTAGCTGCGCC |
| 27 | ACAATGCAGATGCGCCCACCACGGATCACT | 32 | TAATACGACTCACTATAGGCGTAGCCTGATGAGACAATGCAGATGCGCCCACCACGGATCACTCGAAACGTGGTGAAAGCCACGTAGCTGCGCC |
| 28 | CAACCAAGCACGCTGCATCACGTTTCATCG | 33 | TAATACGACTCACTATAGGCGTAGCCTGATGAGCAACCAAGCACGCTGCATCACGTTTCATCGCGAAACGTGGTGAAAGCCACGTAGCTGCGCC |
| 29 | CTCACAGCCCGAAACACATCGCCACGTTCA | 34 | TAATACGACTCACTATAGGCGTAGCCTGATGAGCTCACAGCCCGAAACACATCGCCACGTTCACGAAACGTGGTGAAAGCCACGTAGCTGCGCC |

Fish

| SEQ ID NO. | Core sequence (5'-3') | SEQ ID NO. | Full Sequence (5'-3') |
|---|---|---|---|
| 35 | CTCAATACTACGTCAATTCACAGATGATAGACACCACGGA | 41 | TAATACGACTCACTATAGGCGTAGCCTGATGAGCTCAATACTACGTCAATTCACAGATGATAGACACCACGGACGAAACGTGGTGAAAGCCACGTAGCTGCGCC |
| 36 | TCCAACACCACGTAACGTACACTGCATGTGATTGGTGCAA | 42 | TAATACGACTCACTATAGGCGTAGCCTGATGAGTCCAACACCACGTAACGTACACTGCATGTGATTGGTGCAACGAAACGTGGTGAAAGCCACGTAGCTGCGCC |
| 37 | TGGCGCCGACTGATCAACTAGACATCACGTTAGCATTCCG | 43 | TAATACGACTCACTATAGGCGTAGCCTGATGAGTGGCGCCGACTGATCAACTAGACATCACGTTAGCATTCCGCGAAACGTGGTGAAAGCCACGTAGCTGCGCC |
| 38 | CCAGCAACCAGGTTACCTCCCATCACGCTTCGTCTCAGGA | 44 | TAATACGACTCACTATAGGCGTAGCCTGATGAGCCAGCAACCAGGTTACCTCCCATCACGCTTCGTCTCAGGACGAAACGTGGTGAAAGCCACGTAGCTGCGCC |
| 39 | CTGACACCACAAACGATTATGACCACGTTATCGTACATAG | 45 | TAATACGACTCACTATAGGCGTAGCCTGATGAGCTGACACCACAAACGATTATGACCACGTTATCGTACATAGCGAAACGTGGTGAAAGCCACGTAGCTGCGCC |
| 40 | TAGGTCAAGTGCGCTAAAACACACCGCGTTAGTTCACCAA | 46 | TAATACGACTCACTATAGGCGTAGCCTGATGAGTAGGTCAAGTGCGCTAAAACACACCGCGTTAGTTCACCAACGAAACGTGGTGAAAGCCACGTAGCTGCGCC |

TABLE 1-continued

Aptamers and SPNs that bind common allergens

| SEQ ID NO. | Core sequence (5'-3') | SEQ ID NO. | Full Sequence (5'-3') |
|---|---|---|---|
| Egg ||||
| 47 | GGCCACCTCACTGTGTTTTGTTGCACAACATAATATGATGACGTGC | 53 | TAATACGACTCACTATAGGCGTAGCCTGATGAGGCCACCTCACTGTGTTTTGTTGCACAACATAATATGATGACGTGCCGAAACGTGGTGAAAGCCACGTAGCTGCGCC |
| 48 | GCGTTCCCCACCGTTGCCCACGCTTAACTGGACAAAGATGGGCCC | 54 | TAATACGACTCACTATAGGCGTAGCCTGATGAGGCGTTCCCCACCGTTGCCCACGCTTAACTGGACAAAGATGGGCCCCGAAACGTGGTGAAAGCCACGTAGCTGCGCC |
| 49 | TCTGTGCACATCACTCGACCTCTACGGCTGTATTGATCCTGCATA | 55 | TAATACGACTCACTATAGGCGTAGCCTGATGAGTCTGTGCACATCACTCGACCTCTACGGCTGTATTGATCCTGCATACGAAACGTGGTGAAAGCCACGTAGCTGCGCC |
| 50 | CGTCCAACGTTCGATCAGAACCGCGTTCAGGCTGATGATTGTACG | 56 | TAATACGACTCACTATAGGCGTAGCCTGATGAGCGTCCAACGTTCGATCAGAACCGCGTTCAGGCTGATGATTGTACGCGAAACGTGGTGAAAGCCACGTAGCTGCGCC |
| 51 | CATCAGTGCGTTCTGCCTTTGCAACCACACAACACACCGTATGAG | 57 | TAATACGACTCACTATAGGCGTAGCCTGATGAGCATCAGTGCGTTCTGCCTTTGCAACCACACAACACACCGTATGAGCGAAACGTGGTGAAAGCCACGTAGCTGCGCC |
| 52 | CCAACTGTGCACACTGTTCGCTTATCGAGCTGTGTACCTCCATAG | 58 | TAATACGACTCACTATAGGCGTAGCCTGATGAGCCAACTGTGCACACTGTTCGCTTATCGAGCTGTGTACCTCCATAGCGAAACGTGGTGAAAGCCACGTAGCTGCGCC |
| Gluten ||||
| 59 | CTTGGTCACCTTTCCTGACATTAACACAGG | 65 | TAATACGACTCACTATAGGCGTAGCCTGATGAGCTTGGTCACCTTTCCTGACATTAACACAGGCGAAACGTGGTGAAAGCCACGTAGCTGCGCC |
| 60 | TTTTCCCGATACGGCTACGAATTGCGACAA | 66 | TAATACGACTCACTATAGGCGTAGCCTGATGAGTTTTCCCGATACGGCTACGAATTGCGACAACGAAACGTGGTGAAAGCCACGTAGCTGCGCC |
| 61 | GCACCAATTTTACCGATTTTGGTGGACAGC | 67 | TAATACGACTCACTATAGGCGTAGCCTGATGAGGCACCAATTTTACCGATTTTGGTGGACAGCCGAAACGTGGTGAAAGCCACGTAGCTGCGCC |
| 62 | CGTACAACCCACCACCGTTGTCCACAAATG | 68 | TAATACGACTCACTATAGGCGTAGCCTGATGAGCGTACAACCCACCACCGTTGTCCACAAATGCGAAACGTGGTGAAAGCCACGTAGCTGCGCC |
| 63 | TGCGTCAACGGCCGTCCCGAAACGTGAATA | 69 | TAATACGACTCACTATAGGCGTAGCCTGATGAGTGCGTCAACGGCCGTCCCGAAACGTGAATACGAAACGTGGTGAAAGCCACGTAGCTGCGCC |
| 64 | GTTACCCCGAAACGGCCCTAACTGCATCAG | 70 | TAATACGACTCACTATAGGCGTAGCCTGATGAGGTTACCCCGAAACGGCCCTAACTGCATCAGCGAAACGTGGTGAAAGCCACGTAGCTGCGCC |
| Soy ||||
| 71 | CCGCATCACCACCCAAACCACCGTT | 76 | TAATACGACTCACTATAGGCGTAGCCTGATGAGCCGCATCACCACCCAAACCACCGTTCGAAACGTGGTGAAAGCCACGTAGCTGCGCC |
| 72 | CCTGCTCCATCCGCGCCAGCCTCAC | 77 | TAATACGACTCACTATAGGCGTAGCCTGATGAGCCTGCTCCATCCGCGCCAGCCTCACCGAAACGTGGTGAAAGCCACGTAGCTGCGCC |
| 73 | CCAATCTCCTGCCCACGCCGTTCCA | 78 | TAATACGACTCACTATAGGCGTAGCCTGATGAGCCAATCTCCTGCCCACGCCGTTCCACGAAACGTGGTGAAAGCCACGTAGCTGCGCC |
| 74 | CCAATCAAGGACCGCCTTCACCGCT | 79 | TAATACGACTCACTATAGGCGTAGCCTGATGAGCCAATCAAGGACCGCCTTCACCGCTCGAAACGTGGTGAAAGCCACGTAGCTGCGCC |
| 75 | ACTCTCGCATCACCAGCCAACTCAC | 80 | TAATACGACTCACTATAGGCGTAGCCTGATGAGACTCTCGCATCACCAGCCAACTCACCGAAACGTGGTGAAAGCCACGTAGCTGCGCC |
| Crustacean ||||
| 81 | CGGTACTCAGATTACAGAGTGACAT | 86 | TAATACGACTCACTATAGGCGTAGCCTGATGAGCGGTACTCAGATTACAGAGTGACATCGAAACGTGGTGAAAGCCACGTAGCTGCGCC |
| 82 | AGACACCACGGATCCGAACTGGAG | 87 | TAATACGACTCACTATAGGCGTAGCCTGATGAGAGACACCACGGATCCGAACTGGAGCGAAACGTGGTGAAAGCCACGTAGCTGCGCC |

TABLE 1-continued

Aptamers and SPNs that bind common allergens

| SEQ ID NO. | Core sequence (5'-3') | SEQ ID NO. | Full Sequence (5'-3') |
|---|---|---|---|
| 83 | CCTCGCAAGATTGCATACGTTAGAA | 88 | TAATACGACTCACTATAGGCGTAGCCTGATGAGCCTCGCAAGATTGCATACGTTAGAACGAAACGTGGTGAAAGCCACGTAGCTGCGCC |
| 84 | CACGTAGGAAACGACCTCTACGGAG | 89 | TAATACGACTCACTATAGGCGTAGCCTGATGAGCACGTAGGAAACGACCTCTACGGAGCGAAACGTGGTGAAAGCCACGTAGCTGCGCC |
| 85 | CCCGAAACCACCACCGTTGTCCAATA | 90 | TAATACGACTCACTATAGGCGTAGCCTGATGAGCCCGAAACCACCACCGTTGTCCAATACGAAACGTGGTGAAAGCCACGTAGCTGCGCC |

In some embodiments, signaling polynucleotides of the present invention may be generated by modifying the original allergen binding aptamers disclosed in the literature. The parent sequence of each aptamer against a specific allergen is modified to comprise the shortest sequence without changing the binding specificity and affinity of the aptamer. Some exemplary signaling polynucleotides modified from known parent sequences are listed in Table 2.

TABLE 2

SPNs originated from literature sequences

| Allergen | Description | SEQ ID NO. | Sequence (5'-3') |
|---|---|---|---|
| Gluten | GLI4-aptamersequence | 91 | CCAGTCTCCCGTTTACCGCGCCTACACATGTCTGAATGCC |
|  | GLI4-aptamersequence | 92 | CTAGGCGAAATATAGCTACAACTGTCTGAAGGCACCCAAT |
| Egg | Aptamersequence | 93 | ATCTACGAATTCATCAGGGCTAAAGAGTGCAGAGTTACTTAG |
|  | Aptamer sequence | 94 | GCAGCTAAGCAGGCGGCTCACAAAACCATTCGCATGCGGC |
| Ellington and Cox | apatmer sequence | 95 | GGUUGUGAAGAUUGGGAGCGUCGUGGCUAC |
|  | ARAH1-aptamer sequence | 96 | TCGCACATTCCGCTTCTACCGGGGGGTCGAGCTGAGTGGATGCGAATCTGTGGGTGGGCCGTAAGTCCGTGTGTGCGAA |

In some embodiments, aptamer sequences that specific bind to peanut allergen and tree nut allergen were selected through SELEX and top 100 sequences with high relative abundance were selected from each SELEX selection. Their unique sequences and full sequences including the primer sequences are listed in Table 3 (peanut) and Table 4 (tree nut). Complementary sequences specific to an aptamer may be synthesized and screened for the best binding specificity to its corresponding SPN and to the solid support.

TABLE 3

Aptamers against peanut antigen

| SEQ ID NO. | Unique Sequence (5'-3') | SEQ ID NO. | Full sequence including primers (5'-3') |
|---|---|---|---|
| 97 | GGCCTGCGATGGATGTGTGCGTGTATTAGC | 297 | TAGGGAAGAGAAGGACATATGATGGCCTGCGATGGATGTGTGCGTGTATTAGCTTGACTAGTACATGACCACTTGA |
| 98 | GTACGCGCTCTGGATGTGGTTTGTTAGTCT | 298 | TAGGGAAGAGAAGGACATATGATGTACGCGCTCTGGATGTGGTTTGTTAGTCTTTGACTAGTACATGACCACTTGA |
| 99 | GGCCGGCGATGGATGTGGTTGTGCTTGTTT | 299 | TAGGGAAGAGAAGGACATATGATGGCCGGCGATGGATGTGGTTGTGCTTGTTTTTGACTAGTACATGACCACTTGA |
| 100 | GTGCGACCGACCCTATCAGGTGCTCATGTA | 300 | TAGGGAAGAGAAGGACATATGATGTGCGACCGACCCTATCAGGTGCTCATGTATTGACTAGTACATGACCACTTGA |
| 101 | GGCCGCGTCTGGATGTGGTTTTGTCGCGTC | 301 | TAGGGAAGAGAAGGACATATGATGGCCGCGTCTGGATGTGGTTTTGTCGCGTCTTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 102 | GTCCGACGATGGATGTGGATGTATTGGTCT | 302 | TAGGGAAGAGAAGGACATATGATGTCCGACGATGGATGTGGATGTATTGGTCTTTGACTAGTACATGACCACTTGA |
| 103 | GGCCTGCGATGGATGTGGGCTAGTATGGGC | 303 | TAGGGAAGAGAAGGACATATGATGGCCTGCGATGGATGTGGGCTAGTATGGGCTTGACTAGTACATGACCACTTGA |
| 104 | GTTCCGCCGATGGATGTGGGTGTAGTTGTC | 304 | TAGGGAAGAGAAGGACATATGATGTTCCGCCGATGGATGTGGGTGTAGTTGTCTTGACTAGTACATGACCACTTGA |
| 105 | GGCATTCGATGGATGGGGTGGTGTTAGTCT | 305 | TAGGGAAGAGAAGGACATATGATGGCATTCGATGGATGGGTGGTGTTAGTCTTGACTAGTACATGACCACTTGA |
| 106 | GTCCGCAGCTGGATGGGGGAGTGTCTGGTT | 306 | TAGGGAAGAGAAGGACATATGATGTCCGCAGCTGGATGGGGGAGTGTCTGGTTTTGACTAGTACATGACCACTTGA |
| 107 | GTCAGTCGATGGATGTGGGTTGTGCTCGTC | 307 | TAGGGAAGAGAAGGACATATGATGTCAGTCGATGGATGTGGGTTGTGCTCGTCTTGACTAGTACATGACCACTTGA |
| 108 | GTACGACGCGGACCTTCAAGTAGGCGTGTA | 308 | TAGGGAAGAGAAGGACATATGATGTACGACGCGGACCTTCAAGTAGGCGTGTATTGACTAGTACATGACCACTTGA |
| 109 | GGCCTCGAAGCCCTTCAAGCGGTTCATGGA | 309 | TAGGGAAGAGAAGGACATATGATGGCCTCGAAGCCCTTCAAGCGGTTCATGGATTGACTAGTACATGACCACTTGA |
| 110 | GGCCGATCTGGATGGGGGCTCGGGCGAGTC | 310 | TAGGGAAGAGAAGGACATATGATGGCCGATCTGGATGGGGGCTCGGGCGAGTCTTGACTAGTACATGACCACTTGA |
| 111 | GGCCTGCGATGGATGAGGTGCTGCACTAGT | 311 | TAGGGAAGAGAAGGACATATGATGGCCTGCGATGGATGAGGTGCTGCACTAGTTTGACTAGTACATGACCACTTGA |
| 112 | GTACGCGCTCTGGATGTGGTTGGTTAGTCT | 312 | TAGGGAAGAGAAGGACATATGATGTACGCGCTCTGGATGTGGTTGGTTAGTCTTGACTAGTACATGACCACTTGA |
| 113 | GGCCGCCGATGGATGTTGGCATTGCTGGTC | 313 | TAGGGAAGAGAAGGACATATGATGGCCGCCGATGGATGTTGGCATTGCTGGTCTTGACTAGTACATGACCACTTGA |
| 114 | GGCCGATCTGGATGGGGTATGTGTCTAGGC | 314 | TAGGGAAGAGAAGGACATATGATGGCCGATCTGGATGGGGTATGTGTCTAGGCTTGACTAGTACATGACCACTTGA |
| 115 | GTCCGTCGATGGATGGGGTTGGGTTCAGTC | 315 | TAGGGAAGAGAAGGACATATGATGTCCGTCGATGGATGGGGTTGGGTTCAGTCTTGACTAGTACATGACCACTTGA |
| 116 | GTGCTTGGATCCCTATCAGGTGGACGTGTA | 316 | TAGGGAAGAGAAGGACATATGATGTGCTTGGATCCCTATCAGGTGGACGTGTATTGACTAGTACATGACCACTTGA |
| 117 | GTCGTTCGATGGATGTGTGCTGTATGAGTC | 317 | TAGGGAAGAGAAGGACATATGATGTCGTTCGATGGATGTGTGCTGTATGAGTCTTGACTAGTACATGACCACTTGA |
| 118 | GTCCGACGATGGGTGGGGGAATGCGACGGC | 318 | TAGGGAAGAGAAGGACATATGATGTCCGACGATGGGTGGGGGAATGCGACGGCTTGACTAGTACATGACCACTTGA |
| 119 | GTGCGCCGATGGGTGTGTGTCGTGGCTGGT | 319 | TAGGGAAGAGAAGGACATATGATGTGCGCCGATGGGTGTGTGTCGTGGCTGGTTTGACTAGTACATGACCACTTGA |
| 120 | GTCCTGATCTGGGTGTGGGGGTGTGCAGGC | 320 | TAGGGAAGAGAAGGACATATGATGTCCTGATCTGGGTGTGGGGGTGTGCAGGCTTGACTAGTACATGACCACTTGA |
| 121 | GGCCTGACTGGGTGTGGGTAGTTACTTGGC | 321 | TAGGGAAGAGAAGGACATATGATGGCCTGACTGGGTGTGGGTAGTTACTTGGCTTGACTAGTACATGACCACTTGA |
| 122 | GGACGCATCGCCCCTTCGAGTGGACAGGTA | 322 | TAGGGAAGAGAAGGACATATGATGGACGCATCGCCCCTTCGAGTGGACAGGTATTGACTAGTACATGACCACTTGA |
| 123 | GGCCTGACTGGGTGTGGTTAGGAACGCGTC | 323 | TAGGGAAGAGAAGGACATATGATGGCCTGACTGGGTGTGGTTAGGAACGCGTCTTGACTAGTACATGACCACTTGA |
| 124 | GTCATGCGATGGATGGGGGCTGGCAGTCGT | 324 | TAGGGAAGAGAAGGACATATGATGTCATGCGATGGATGGGGCTGGCAGTCGTTTGACTAGTACATGACCACTTGA |
| 125 | AATGTGGCGGGATCTGGATGTGTGCATGTA | 325 | TAGGGAAGAGAAGGACATATGATAATGTGGCGGGATCTGGATGTGTGCATGTATTGACTAGTACATGACCACTTGA |
| 126 | GGCCTGGTCTGGATGGGGGCGGGTATAGGC | 326 | TAGGGAAGAGAAGGACATATGATGGCCTGGTCTGGATGGGGCGGGTATAGGCTTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 127 | GGCCTGGGATGGATGTGGTGTATTAGGCTG | 327 | TAGGGAAGAGAAGGACATATGATGGCCTGGGATGGATGTGGTGTATTAGGCTGTTGACTAGTACATGACCACTTGA |
| 128 | GCCCGACTCTGGATGGGGGAATGCGCAGTC | 328 | TAGGGAAGAGAAGGACATATGATGCCCGACTCTGGATGGGGGAATGCGCAGTCTTGACTAGTACATGACCACTTGA |
| 129 | GTCGTGCTCTGGGTGGGGTTGTGTAGTAGT | 329 | TAGGGAAGAGAAGGACATATGATGTCGTGCTCTGGGTGGGGTTGTGTAGTAGTTTGACTAGTACATGACCACTTGA |
| 130 | GTCATTCGCTGGATGTGTTGATGTCTGGTC | 330 | TAGGGAAGAGAAGGACATATGATGTCATTCGCTGGATGTGTTGATGTCTGGTCTTGACTAGTACATGACCACTTGA |
| 131 | GGCCGGCGATGGATGTGTATGTGGTAGTCG | 331 | TAGGGAAGAGAAGGACATATGATGGCCGGCGATGGATGTGTATGTGGTAGTCGTTGACTAGTACATGACCACTTGA |
| 132 | GGACGCGGCTGGATGGGGGCTTGCACTGTC | 332 | TAGGGAAGAGAAGGACATATGATGGACGCGGCTGGATGGGGGCTTGCACTGTCTTGACTAGTACATGACCACTTGA |
| 133 | GGCCGGCGATGGATGTGTGCGTGTATTAGC | 333 | TAGGGAAGAGAAGGACATATGATGGCCGGCGATGGATGTGTGCGTGTATTAGCTTGACTAGTACATGACCACTTGA |
| 134 | GGCCGCCGATGGGTGTGGAGGTGTACTTGT | 334 | TAGGGAAGAGAAGGACATATGATGGCCGCCGATGGGTGTGGAGGTGTACTTGTTTGACTAGTACATGACCACTTGA |
| 135 | GGCCTGCGATGGATGTGGTTGTGCTTGTTT | 335 | TAGGGAAGAGAAGGACATATGATGGCCTGCGATGGATGTGGTTGTGCTTGTTTTTGACTAGTACATGACCACTTGA |
| 136 | GGCCGACGATGGCGTAGCGTCTGTACTGTT | 336 | TAGGGAAGAGAAGGACATATGATGGCCGACGATGGCGTAGCGTCTGTACTGTTTTGACTAGTACATGACCACTTGA |
| 137 | GGCCGTGTCTGGGTGGGGGTATGCACTGTC | 337 | TAGGGAAGAGAAGGACATATGATGGCCGTGTCTGGGTGGGGTATGCACTGTCTTGACTAGTACATGACCACTTGA |
| 138 | GGCCGGCGATGGATGTGAAATGGCTTGTCT | 338 | TAGGGAAGAGAAGGACATATGATGGCCGGCGATGGATGTGAAATGGCTTGTCTTTGACTAGTACATGACCACTTGA |
| 139 | GGCCGCGTCTGGGTGTTGGTTGTGTTAGGC | 339 | TAGGGAAGAGAAGGACATATGATGGCCGCGTCTGGGTGTTGGTTGTGTTAGGCTTGACTAGTACATGACCACTTGA |
| 140 | GGACAGCGATGGATGTGGAAATGCGACGTC | 340 | TAGGGAAGAGAAGGACATATGATGGACAGCGATGGATGTGGAAATGCGACGTCTTGACTAGTACATGACCACTTGA |
| 141 | GGACTGCGCGTGACCTATCAATGGCATGTA | 341 | TAGGGAAGAGAAGGACATATGATGGACTGCGCGTGACCTATCAATGGCATGTATTGACTAGTACATGACCACTTGA |
| 142 | GGCCAGCTCTGGATGAGGTCTGTGCGAGGC | 342 | TAGGGAAGAGAAGGACATATGATGGCCAGCTCTGGATGAGGTCTGTGCGAGGCTTGACTAGTACATGACCACTTGA |
| 143 | GTCCGACCGCACCCTTCGAGGGGACATGGA | 343 | TAGGGAAGAGAAGGACATATGATGTCCGACCGCACCCTTCGAGGGGACATGGATTGACTAGTACATGACCACTTGA |
| 144 | GGCCAATGCGCCCCTTCATGTTGTCGTGTA | 344 | TAGGGAAGAGAAGGACATATGATGGCCAATGCGCCCCTTCATGTTGTCGTGTATTGACTAGTACATGACCACTTGA |
| 145 | GGCCGGCTATACCCTACACGTGATCAGGTA | 345 | TAGGGAAGAGAAGGACATATGATGGCCGGCTATACCCTACACGTGATCAGGTATTGACTAGTACATGACCACTTGA |
| 146 | GTGCGCACGATGGATGTGGATGGCCAGTCT | 346 | TAGGGAAGAGAAGGACATATGATGTGCGCACGATGGATGTGGATGGCCAGTCTTTGACTAGTACATGACCACTTGA |
| 147 | GGCATGCGATGGATGGGGGCTGGGGCAGTC | 347 | TAGGGAAGAGAAGGACATATGATGGCATGCGATGGATGGGGGCTGGGGCAGTCTTGACTAGTACATGACCACTTGA |
| 148 | GTCATGCGCTGGATGTGGGTTGTTATAGGC | 348 | TAGGGAAGAGAAGGACATATGATGTCATGCGCTGGATGTGGGTTGTTATAGGCTTGACTAGTACATGACCACTTGA |
| 149 | GTGCGCCTCTGGATGGGGTTTGTCGACGGC | 349 | TAGGGAAGAGAAGGACATATGATGTGCGCCTCTGGATGGGGTTTGTCGACGGCTTGACTAGTACATGACCACTTGA |
| 150 | GGCCAGCTCTGGATGTGGCATTGTCTGGTC | 350 | TAGGGAAGAGAAGGACATATGATGGCCAGCTCTGGATGTGGCATTGTCTGGTCTTGACTAGTACATGACCACTTGA |
| 151 | GGCCTGAGCTGGCATTGCGCTGGACATGTA | 351 | TAGGGAAGAGAAGGACATATGATGGCCTGAGCTGGCATTGCGCTGGACATGTATTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 152 | GGCCGCCGATGGGTGTGGGATCGTGCGGGC | 352 | TAGGGAAGAGAAGGACATATGATGGCCGCCGATGGGTGTGGGATCGTGCGGGCTTGACTAGTACATGACCACTTGA |
| 153 | GGCCGACGCTGGGTGGGGCGTTGACTACGT | 353 | TAGGGAAGAGAAGGACATATGATGGCCGACGCTGGGTGGGGCGTTGACTAGTTTTGACTAGTACATGACCACTTGA |
| 154 | GGACTACGCTGGATGGGGACATTGCTAGTT | 354 | TAGGGAAGAGAAGGACATATGATGGACTACGCTGGATGGGGACATTGCTAGTTTTGACTAGTACATGACCACTTGA |
| 155 | GGCATGCGATGGGTGTGTTCTGGCGACGGC | 355 | TAGGGAAGAGAAGGACATATGATGGCATGCGATGGGTGTGTTCTGGCGACGGCTTGACTAGTACATGACCACTTGA |
| 156 | GGACTACGCTGGATGTGGGTTGGGGTAGTC | 356 | TAGGGAAGAGAAGGACATATGATGGACTACGCTGGATGTGGGTTGGGGTAGTCTTGACTAGTACATGACCACTTGA |
| 157 | GGCCGAGCTTACCTGTCAAGTGCGAGTGTA | 357 | TAGGGAAGAGAAGGACATATGATGGCCGAGCTTACCTGTCAAGTGCGAGTGTATTGACTAGTACATGACCACTTGA |
| 158 | GTGCTTCGATGGATGTGGGCGTTGCAAGTC | 358 | TAGGGAAGAGAAGGACATATGATGTGCTTCGATGGATGTGGGCGTTGCAAGTCTTGACTAGTACATGACCACTTGA |
| 159 | GTCCGCGGCTGGGTGTGGGAAGTACTCGGC | 359 | TAGGGAAGAGAAGGACATATGATGTCCGCGGCTGGGTGTGGGAAGTACTCGGCTTGACTAGTACATGACCACTTGA |
| 160 | GTCCGCGCGATGGATGAGGACGTGAGCTAG | 360 | TAGGGAAGAGAAGGACATATGATGTCCGCGCGATGGATGAGGACGTGAGCTAGTTGACTAGTACATGACCACTTGA |
| 161 | GGCCGAGTCGTCACTTCAATTGGGCGTGGA | 361 | TAGGGAAGAGAAGGACATATGATGGCCGAGTCGTCACTTCAATTGGGCGTGGATTGACTAGTACATGACCACTTGA |
| 162 | GTCGGTCGGAGGGATGGTCTCGTTGACGGC | 362 | TAGGGAAGAGAAGGACATATGATGTCGGTCGGAGGGATGGTCTCGTTGACGGCTTGACTAGTACATGACCACTTGA |
| 163 | GGCCACACGCTGCCCTAAAGTGTTCGTGTA | 363 | TAGGGAAGAGAAGGACATATGATGGCCACACGCTGCCCTAAAGTGTTCGTGTATTGACTAGTACATGACCACTTGA |
| 164 | GGCCTGCGATGGATGTGTGCGTGTATTAGT | 364 | TAGGGAAGAGAAGGACATATGATGGCCTGCGATGGATGTGTGCGTGTATTAGTTTGACTAGTACATGACCACTTGA |
| 165 | GTGCGCTGTCTTGCCTACAAGTGTCGTGTA | 365 | TAGGGAAGAGAAGGACATATGATGTGCGCTGTCTTGCCTACAAGTGTCGTGTATTGACTAGTACATGACCACTTGA |
| 166 | GGCCGGAACTGGATGGGGGCATTACTGCGGC | 366 | TAGGGAAGAGAAGGACATATGATGGCCGAACTGGATGGGGGCATTACTGCGGCTTGACTAGTACATGACCACTTGA |
| 167 | GGCCGAGCTGGATGGGGTATTGGATCTAGT | 367 | TAGGGAAGAGAAGGACATATGATGGCCGAGCTGGATGGGGTATTGGATCTAGTTTGACTAGTACATGACCACTTGA |
| 168 | TGGCCGCACTCTGGGTGTGGTGGACTTGGC | 368 | TAGGGAAGAGAAGGACATATGATTGGCCGCACTCTGGGTGTGGTGGACTTGGCTTGACTAGTACATGACCACTTGA |
| 169 | GGCCGGTCTGGATGGGGCGTACGTCGTCG | 369 | TAGGGAAGAGAAGGACATATGATGGCCGGTCTGGATGGGGGCGTACGTCGTCGTTGACTAGTACATGACCACTTGA |
| 170 | GGCCTGCTATGGGTGGGGCTCGTACTGGC | 370 | TAGGGAAGAGAAGGACATATGATGGCCTGCTATGGGTGGGGCTCGTACTGGCTTGACTAGTACATGACCACTTGA |
| 171 | GTACGCCCGATGGATGTGGATTGTACTGTT | 371 | TAGGGAAGAGAAGGACATATGATGTACGCCCGATGGATGTGGATTGTACTGTTTTGACTAGTACATGACCACTTGA |
| 172 | GGCCTGCGATGGATGTGGGCCAGTACGCGC | 372 | TAGGGAAGAGAAGGACATATGATGGCCTGCGATGGATGTGGGCCAGTACGCGCTTGACTAGTACATGACCACTTGA |
| 173 | GACCTGCGATGGGTGTGGCTCTGTCAGTCT | 373 | TAGGGAAGAGAAGGACATATGATGACCTGCGATGGGTGTGGCTCTGTCAGTCTTTGACTAGTACATGACCACTTGA |
| 174 | GTCCGAACTGGATGTGGTATTGGCCTGTCT | 374 | TAGGGAAGAGAAGGACATATGATGTCCGAACTGGATGTGGTATTGGCCTGTCTTTGACTAGTACATGACCACTTGA |
| 175 | GTTCTTGTCTGGATGGGGTTGATGTCGGTC | 375 | TAGGGAAGAGAAGGACATATGATGTTCTTGTCTGGATGGGGTTGATGTCGGTCTTGACTAGTACATGACCACTTGA |
| 176 | GTACTCGATGGGTGTGGGTAGGCGCGAGTC | 376 | TAGGGAAGAGAAGGACATATGATGTACTCGATGGGTGTGGGTAGGCGCGAGTCTTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 177 | GTCCTCGATGGGTGTGAGATATGTGCTAGC | 377 | TAGGGAAGAGAAGGACATATGATGTCCTCGATGGGTGTGAGATATGTGCTAGCTTGACTAGTACATGACCACTTGA |
| 178 | GGCCGTGCTCTGGGTGTGGGCCTGCTGGGC | 378 | TAGGGAAGAGAAGGACATATGATGGCCGTGCTCTGGGTGTGGGCCTGCTGGGCTTGACTAGTACATGACCACTTGA |
| 179 | GTTCGTATCTGGGGTGTGGTGTGTCTGGGCT | 379 | TAGGGAAGAGAAGGACATATGATGTTCGTATCTGGGTGTGGTGTGTCTGGGCTTGACTAGTACATGACCACTTGA |
| 180 | GGCCGAGTCTGGATGTGTGTCGTACGTATC | 380 | TAGGGAAGAGAAGGACATATGATGGCCGAGTCTGGATGTGTGTCGTACGTATCTTGACTAGTACATGACCACTTGA |
| 181 | GGCGTTCACTGGGTGTGGATGTGTGCGGTC | 381 | TAGGGAAGAGAAGGACATATGATGGCGTTCACTGGGTGTGGATGTGTGCGGTCTTGACTAGTACATGACCACTTGA |
| 182 | GTCATGCGCTGGGTGTGGCCTGTTGTAGGC | 382 | TAGGGAAGAGAAGGACATATGATGTCATGCGCTGGGTGTGGCCTGTTGTAGGCTTGACTAGTACATGACCACTTGA |
| 183 | GCTCCGTACGATGGCTGTGCTGGTGATGTA | 383 | TAGGGAAGAGAAGGACATATGATGCTCCGTACGATGGCTGTGCTGGTGATGTATTGACTAGTACATGACCACTTGA |
| 184 | GGACTGCGATGGGTGGGGTTATGTGCCAGC | 384 | TAGGGAAGAGAAGGACATATGATGGACTGCGATGGGTGGGGTTATGTGCCAGCTTGACTAGTACATGACCACTTGA |
| 185 | GTGCGATCGTACCTATCAATGGTCATCGTA | 385 | TAGGGAAGAGAAGGACATATGATGTGCGATCGTACCTATCAATGGTCATCGTATTGACTAGTACATGACCACTTGA |
| 186 | GTTCGTCGAATGGATGTGAGCATGTCTGTC | 386 | TAGGGAAGAGAAGGACATATGATGTTCGTCGAATGGATGTGAGCATGTCTGTCTTGACTAGTACATGACCACTTGA |
| 187 | GGCCGTACGATGGATGTGGGATGGTCTAGC | 387 | TAGGGAAGAGAAGGACATATGATGGCCGTACGATGGATGTGGGATGGTCTAGCTTGACTAGTACATGACCACTTGA |
| 188 | GTCATTAACTGGATGTGGGACTGTCGGTCT | 388 | TAGGGAAGAGAAGGACATATGATGTCATTAACTGGATGTGGGACTGTCGGTCTTTGACTAGTACATGACCACTTGA |
| 189 | GGACGATCTGGGTGTGGACAGGGATGAGGC | 389 | TAGGGAAGAGAAGGACATATGATGGACGATCTGGGTGTGGACAGGGATGAGGCTTGACTAGTACATGACCACTTGA |
| 190 | GGCATGCGATGGATGTGGTGTACCCAGTCC | 390 | TAGGGAAGAGAAGGACATATGATGGCATGCGATGGATGTGGTGTACCCAGTCCTTGACTAGTACATGACCACTTGA |
| 191 | GGCCGCGATGGATGTGGAAAGGTCTAGTCA | 391 | TAGGGAAGAGAAGGACATATGATGGCCGCGATGGATGTGGAAAGGTCTAGTCATTGACTAGTACATGACCACTTGA |
| 192 | GGCCGACCTGGATGTGAGCATGCATCTAGT | 392 | TAGGGAAGAGAAGGACATATGATGGCCGACCTGGATGTGAGCATGCATCTAGTTTGACTAGTACATGACCACTTGA |
| 193 | GTACGAGCGGACCGATCAAGTGCGTCTGTA | 393 | TAGGGAAGAGAAGGACATATGATGTACGAGCGGACCGATCAAGTGCGTCTGTATTGACTAGTACATGACCACTTGA |
| 194 | GTACTGCACTGCCCTACACGTGGGAATGGA | 394 | TAGGGAAGAGAAGGACATATGATGTACTGCACTGCCCTACACGTGGGAATGGATTGACTAGTACATGACCACTTGA |
| 195 | GTCATTCGATGGATGTGGCGTGTGCGTCAT | 395 | TAGGGAAGAGAAGGACATATGATGTCATTCGATGGATGTGGCGTGTGCGTCATTTGACTAGTACATGACCACTTGA |
| 196 | GGCGTACGATGGATTGCGTTGTGTCTGTC | 396 | TAGGGAAGAGAAGGACATATGATGGCGTACGATGGATGTGCGTTGTGTCTGTCTTGACTAGTACATGACCACTTGA |
| 197 | GGCCTGCGATGGATGTGTGCGTGTATTAGC | 397 | TAGGGAAGAGAAGGACATATGATGGCCTGCGATGGATGTGTGCGTGTATTAGCTTGACTAGTACATGACCACTTGA |
| 198 | GTCATTCCGCATCCTACACGTGGGCACGTA | 398 | TAGGGAAGAGAAGGACATATGATGTCATTCCGCATCCTACACGTGGGCACGTATTGACTAGTACATGACCACTTGA |
| 199 | GGCCAATGCGCCCCTTCATGTTGTCGTGTA | 399 | TAGGGAAGAGAAGGACATATGATGGCCAATGCGCCCCTTCATGTTGTCGTGTATTGACTAGTACATGACCACTTGA |
| 200 | GGCCTGCGATGGATAGGTGCTGCACTAGT | 400 | TAGGGAAGAGAAGGACATATGATGGCCTGCGATGGATGAGGTGCTGCACTAGTTTGACTAGTACATGACCACTTGA |
| 201 | GTCAGTCGATGGATGTGGGTTGTGCTCGTC | 401 | TAGGGAAGAGAAGGACATATGATGTCAGTCGATGGATGTGGGTTGTGCTCGTCTTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 202 | GTCGTGACTGGCTAGCTGGACATGCACTGC | 402 | TAGGGAAGAGAAGGACATATGATGTCGTGACTGGCTAGCTGGACATGCACTGCTTGACTAGTACATGACCACTTGA |
| 203 | GGCCTGCGATGGATGTGGGCTAGTATGGGC | 403 | TAGTGGAAGAGAAGGACATATGATGGCCTGCGATGGATGTGGGCTAGTATGGGCTTGACTAGTACATGACCACTTGA |
| 204 | GTGCATCGATGGCGTATGCTGGTGATGTGC | 404 | TAGGGAAGAGAAGGACATATGATGTGCATCGATGGCGTATGCTGGTGATGTGCTTGACTAGTACATGACCACTTGA |
| 205 | GCGACAGCGACATACGATCTGCTCTGCGTC | 405 | TAGGGAAGAGAAGGACATATGATGCGACAGCGACATACGATCTGCTCTGCGTCTTGACTAGTACATGACCACTTGA |
| 206 | GTCATGCCATCCCTTCGAGTGTGACAGGTA | 406 | TAGGGAAGAGAAGGACATATGATGTCATGCCATCCCTTCGAGTGTGACAGGTATTGACTAGTACATGACCACTTGA |
| 207 | GGCCTGACTGGGTGTGGTTAGGAACGCGTC | 407 | TAGGGAAGAGAAGGACATATGATGGCCTGACTGGGTGTGGTTAGGAACGCGTCTTGACTAGTACATGACCACTTGA |
| 208 | GTGCGCACGATGGATGTGGATGGCCAGTCT | 408 | TAGGGAAGAGAAGGACATATGATGTGCGCACGATGGATGTGGATGGCCAGTCTTTGACTAGTACATGACCACTTGA |
| 209 | GTGCGCCGATGGGTGTGTGTCGTGGCTGGT | 409 | TAGGGAAGAGAAGGACATATGATGTGCGCCGATGGGTGTGTGTCGTGGCTGGTTTGACTAGTACATGACCACTTGA |
| 210 | GGCATGCGATGGATGTGGTGTACCCAGTCC | 410 | TAGGGAAGAGAAGGACATATGATGGCATGCGATGGATGTGGTGTACCCAGTCCTTGACTAGTACATGACCACTTGA |
| 211 | CCATATGGCAGTGCGATGGCTTCGCTGGTC | 411 | TAGGGAAGAGAAGGACATATGATCCATATGGCAGTGCGATGGCTTCGCTGGTCTTGACTAGTACATGACCACTTGA |
| 212 | GCTCCGTACGATGGCTGTGCTGGTGATGTA | 412 | TAGGGAAGAGAAGGACATATGATGCTCCGTACGATGGCTGTGCTGGTGATGTATTGACTAGTACATGACCACTTGA |
| 213 | GTGCGACCGACCCTATCAGGTGCTCATGTA | 413 | TAGGGAAGAGAAGGACATATGATGTGCGACCGACCCTATCAGGTGCTCATGTATTGACTAGTACATGACCACTTGA |
| 214 | GTTCCGCCGATGGATGTGGGTGTAGTTGTC | 414 | TAGGGAAGAGAAGGACATATGATGTTCCGCCGATGGATGTGGGTGTAGTTGTCTTGACTAGTACATGACCACTTGA |
| 215 | GTACTGCACTGCCCTACACGTGGGAATGGA | 415 | TAGGGAAGAGAAGGACATATGATGTACTGCACTGCCCTACACGTGGGAATGGATTGACTAGTACATGACCACTTGA |
| 216 | CGCACCGTCGATACGTCATGCACGCTGACA | 416 | TAGGGAAGAGAAGGACATATGATCGCACCGTCGATACGTCATGCACGCTGACATTGACTAGTACATGACCACTTGA |
| 217 | GTACGCACGATGAGCGCCAAGTGACATGGA | 417 | TAGGGAAGAGAAGGACATATGATGTACGCACGATGAGCGCCAAGTGACATGGATTGACTAGTACATGACCACTTGA |
| 218 | GTCGGTCGGAGGGATGGTCTCGTTGACGGC | 418 | TAGGGAAGAGAAGGACATATGATGTCGGTCGGAGGGATGGTCTCGTTGACGGCTTGACTAGTACATGACCACTTGA |
| 219 | GGCATGCGATGAACGAGGCATGATGCGTCA | 419 | TAGGGAAGAGAAGGACATATGATGGCATGCGATGAACGAGGCATGATGCGTCATTGACTAGTACATGACCACTTGA |
| 220 | GGCGTACGATGGATGTGCGTTGTGTCTGTC | 420 | TAGGGAAGAGAAGGACATATGATGGCGTACGATGGATGTGCGTTGTGTCTGTCTTGACTAGTACATGACCACTTGA |
| 221 | GTCACTGTGCCTGACCGTCAAGTTGCGGCA | 421 | TAGGGAAGAGAAGGACATATGATGTCACTGTGCCTGACCGTCAAGTTGCGGCATTGACTAGTACATGACCACTTGA |
| 222 | GGACTGCGCGTGACCTATCAATGGCATGTA | 422 | TAGGGAAGAGAAGGACATATGATGGACTGCGCGTGACCTATCAATGGCATGTATTGACTAGTACATGACCACTTGA |
| 223 | GGCCTGAGCTGGCATTGCGCTGGACATGTA | 423 | TAGGGAAGAGAAGGACATATGATGGCCTGAGCTGGCATTGCGCTGGACATGTATTGACTAGTACATGACCACTTGA |
| 224 | GCATTGGACGATCGTGCCCTACACGTGGGC | 424 | TAGGGAAGAGAAGGACATATGATGCATTGGACGATCGTGCCCTACACGTGGGCTTGACTAGTACATGACCACTTGA |
| 225 | GGACGCATCGCCCCTTCGAGTGGACAGGTA | 425 | TAGGGAAGAGAAGGACATATGATGGACGCATCGCCCCTTCGAGTGGACACGGTATTGACTAGTACATGACCACTTGA |
| 226 | GGCCACACGCTGCCCTAAAGTGTTCGTGTA | 426 | TAGGGAAGAGAAGGACATATGATGGCCACACGCTGCCCTAAAGTGTTCGTGTATTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 227 | GTTCTGACTGGGTGTGGTGCTGCACTGTCA | 427 | TAGGGAAGAGAAGGACATATGATGTTCTGACTGGGTGTGGTGCTGCACTGTCATTGACTAGTACATGACCACTTGA |
| 228 | GGCAACGCACATCGTATCACGCATCGGACC | 428 | TAGGGAAGAGAAGGACATATGATGGCAACGCACATCGTATCACGCATCGGACCTTGACTAGTACATGACCACTTGA |
| 229 | GTCATGCGCGGACATTCAAGTTGGCGTGGA | 429 | TAGGGAAGAGAAGGACATATGATGTCATGCGCGGACATTCAAGTTGGCGTGGATTGACTAGTACATGACCACTTGA |
| 230 | CCGTAGCGACATCAAGCGGTGGTGTGCGTG | 430 | TAGGGAAGAGAAGGACATATGATCCGTAGCGACATCAAGCGGTGGTGTGCGTGTTGACTAGTACATGACCACTTGA |
| 231 | GTACGACGCGGACCTTCAAGTAGGCGTGTA | 431 | TAGGGAAGAGAAGGACATATGATGTACGACGCGGACCTTCAAGTAGGCGTGTATTGACTAGTACATGACCACTTGA |
| 232 | GACCTGACTGTGCCTATCGAGTGCGTGATG | 432 | TAGGGAAGAGAAGGACATATGATGACCTGACTGTGCCTATCGAGTGCGTGATGTTGACTAGTACATGACCACTTGA |
| 233 | TGGCCGATCGACCCTATCAAGTGCAGCATG | 433 | TAGGGAAGAGAAGGACATATGATTGGCCGATCGACCCTATCAAGTGCAGCATGTTGACTAGTACATGACCACTTGA |
| 234 | GTTCCGAGCTGGATGTGGCCTGTGCTATGC | 434 | TAGGGAAGAGAAGGACATATGATGTTCCGAGCTGGATGTGGCCTGTGCTATGCTTGACTAGTACATGACCACTTGA |
| 235 | GGCATGCGATGGATGTGTGCGTGTATTAGC | 435 | TAGGGAAGAGAAGGACATATGATGGCATGCGATGGATGTGTGCGTGTATTAGCTTGACTAGTACATGACCACTTGA |
| 236 | GTACGCATCGTCCCGTCATGTGGTTCCGTA | 436 | TAGGGAAGAGAAGGACATATGATGTACGCATCGTCCCGTCATGTGGTTCCGTATTGACTAGTACATGACCACTTGA |
| 237 | GGCATTGCGCGCCTAGCAAGTTGACGTGTA | 437 | TAGGGAAGAGAAGGACATATGATGGCATTGCGCGCCTAGCAAGTTGACGTGTATTGACTAGTACATGACCACTTGA |
| 238 | GGACGCACGCAGACCTTCAAGTCGGCCATG | 438 | TAGGGAAGAGAAGGACATATGATGGACGCACGCAGACCTTCAAGTCGGCCATGTTGACTAGTACATGACCACTTGA |
| 239 | GTGCTGCATGAGCGGTGTGCGTGTACGACG | 439 | TAGGGAAGAGAAGGACATATGATGTGCTGCATGAGCGGTGTGCGTGTACGACGTTGACTAGTACATGACCACTTGA |
| 240 | GTCATGCTCGACACTATCAGGTGTGCATGGA | 440 | TAGGGAAGAGAAGGACATATGATGTCATGCTCGCACTATCAGGTGTGCATGGATTGACTAGTACATGACCACTTGA |
| 241 | GTGCGCGGCTTGCCTTCACGTGATCGTGTA | 441 | TAGGGAAGAGAAGGACATATGATGTGCGCGGCTTGCCTTCACGTGATCGTGTATTGACTAGTACATGACCACTTGA |
| 242 | GTCATACGATGGGTGTGGTATGTGTACGTA | 442 | TAGGGAAGAGAAGGACATATGATGTCATACGATGGGTGTGGTATGTGTACGTATTGACTAGTACATGACCACTTGA |
| 243 | GCATGCGTTGGACTTGTCTGGCTGTGGGTG | 443 | TAGGGAAGAGAAGGACATATGATGCATGCGTTGGACTTGTCTGGCTGTGGGTGTTGACTAGTACATGACCACTTGA |
| 244 | TGCGTCGTATGTGCGGCTCGGATGTGTGTC | 444 | TAGGGAAGAGAAGGACATATGATTGCGTCGTATGTGCGGCTCGGATGTGTGTCTTGACTAGTACATGACCACTTGA |
| 245 | GGACGCAGCTTGCCTACTGGTGGTCACGTA | 445 | TAGGGAAGAGAAGGACATATGATGGACGCAGCTTGCCTACTGGTGGTCACGTATTGACTAGTACATGACCACTTGA |
| 246 | GGCCATCGATGGGTGTGGCTGTACTTGACA | 446 | TAGGGAAGAGAAGGACATATGATGGCCATCGATGGGTGTGGCTGTACTTGACATTGACTAGTACATGACCACTTGA |
| 247 | GCGTGTCAGCAATACGTCCTCATCTGCCCG | 447 | TAGGGAAGAGAAGGACATATGATGCGTGTCAGCAATACGTCCTCATCTGCCCGTTGACTAGTACATGACCACTTGA |
| 248 | GTGCGATCGTACCTATCAATGGTCATCGTA | 448 | TAGGGAAGAGAAGGACATATGATGTGCGATCGTACCTATCAATGGTCATCGTATTGACTAGTACATGACCACTTGA |
| 249 | GGCATGCGATGGATGGGGGCTGGGGCAGTC | 449 | TAGGGAAGAGAAGGACATATGATGGCATGCGATGGATGGGGGCTGGGGCAGTCTTGACTAGTACATGACCACTTGA |
| 250 | GGCCGACGATGGCGTAGCGTCTGTACTGTT | 450 | TAGGGAAGAGAAGGACATATGATGGCCGACGATGGCGTAGCGTCTGTACTGTTTTGACTAGTACATGACCACTTGA |
| 251 | TGGCCGATCATCCCTCAAGTTGGCGTGTGC | 451 | TAGGGAAGAGAAGGACATATGATTGGCCGATCATCCCTCAAGTTGGCGTGTGCTTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 252 | GGCCGTACGATGGATGTGGGATGGTCTAGC | 452 | TAGGGAAGAGAAGGACATATGATGGCCGTACGATGGATGTGGGATGGTCTAGCTTGACTAGTACATGACCACTTGA |
| 253 | GGCACAAACGGACCGACAAGTGCGCATGGA | 453 | TAGGGAAGAGAAGGACATATGATGGCACAAACGGACCGACAAGTGCGCATGGATTGACTAGTACATGACCACTTGA |
| 254 | GTACGGAACGGAACAACAAGGGCAGGCATG | 454 | TAGGGAAGAGAAGGACATATGATGTACGGAACGGAACAACAAGGGCAGGCATGTTGACTAGTACATGACCACTTGA |
| 255 | GGACGCACATCCCGTTCATGTGTGCATGTA | 455 | TAGGGAAGAGAAGGACATATGATGGACGCACATCCCGTTCATGTGTGCATGTATTGACTAGTACATGACCACTTGA |
| 256 | GGCCAAGCTGGATGTGTTCAGGTCACGACG | 456 | TAGGGAAGAGAAGGACATATGATGGCCAAGCTGGATGTGTTCAGGTCACGACGTTGACTAGTACATGACCACTTGA |
| 257 | GGCCTGCGATGGATGTGTGCGTGTA | 457 | TAGGGAAGAGAAGGACATATGATGGCCTGCGATGGATGTGTGCGTGTATTGACTAGTACATGACCACTTGA |
| 258 | CGTGCGCGAGACATGTCCATCGGTTCGTG | 458 | TAGGGAAGAGAAGGACATATGATCGTGCGCGAGACATGGTCCATCGGTTCGTGTTGACTAGTACATGACCACTTGA |
| 259 | GTCATGCGCTGGGTGTGGCCTGTTGTAGGC | 459 | TAGGGAAGAGAAGGACATATGATGTCATGCGCTGGGTGTGGCCTGTTGTAGGCTTGACTAGTACATGACCACTTGA |
| 260 | GTCGCGATGAGCTAGCATGTGCGTTGTGTA | 460 | TAGGGAAGAGAAGGACATATGATGTCGCGATGAGCTAGCATGTGCGTTGTGTATTGACTAGTACATGACCACTTGA |
| 261 | GTGCTACGATGGCTGTGGGCGTGATGCGTA | 461 | TAGGGAAGAGAAGGACATATGATGTGCTACGATGGCTGTGGGCGTGATGCGTATTGACTAGTACATGACCACTTGA |
| 262 | GACGCTGCGTTCCCTATCATGTGCGGCATG | 462 | TAGGGAAGAGAAGGACATATGATGACGCTGCGTTCCCTATCATGTGCGGCATGTTGACTAGTACATGACCACTTGA |
| 263 | GTTCGCGCGACACCTATCAATGTGGACGTG | 463 | TAGGAAGAGAAGGACATATGATGTCCGCGCGACACCTATCAATGTGGACGTGTTGACTAGTACATGACCACTTGA |
| 264 | GCACGACTCGCACCCTATCATGAGGCCATG | 464 | TAGGGAAGAGAAGGACATATGATGCACGACTCGCACCCTATCATGAGGCCATGTTGACTAGTACATGACCACTTGA |
| 265 | GTCATGAAACGAGCCTACACGTGGTGCATG | 465 | TAGGGAAGAGAAGGACATATGATGTCATGAAACGAGCCTACACGTGGTGCATGTTGACTAGTACATGACCACTTGA |
| 266 | GGACGCGATGGGCGTGGGTATGCACTTGGC | 466 | TAGGGAAGAGAAGGACATATGATGGACGCGATGGGCGTGGGTATGCACTTGGCTTGACTAGTACATGACCACTTGA |
| 267 | GTACTGCGATGGCTTAGCAAAGTGCGACATG | 467 | TAGGGAAGAGAAGGACATATGATGTACTGCGATGGCTTAGCAAAGTGCGACATGTTGACTAGTACATGACCACTTGA |
| 268 | TGCCCTGGCAATGCGATGTTCGATGCGACC | 468 | TAGGGAAGAGAAGGACATATGATTGCCCTGGCAATGCGATGTTCGATGCGACCTTGACTAGTACATGACCACTTGA |
| 269 | GTACGCGACGTCCCTGAGAGTGTGCAGGTA | 469 | TAGGGAAGAGAAGGACATATGATGTACGCGACGTCCCTGAGAGTGTGCAGGTATTGACTAGTACATGACCACTTGA |
| 270 | GTGCGCCGATATCCCTTCACAGTTGGCATG | 470 | TAGGGAAGAGAAGGACATATGATGTGCGCCGATATCCCTTCACAGTTGGCATGTTGACTAGTACATGACCACTTGA |
| 271 | GGCCGACGATGGATGGGAGGCATGACTGGC | 471 | TAGGGAAGAGAAGGACATATGATGGCCGACGATGGATGGGAGGCATGACTGGCTTGACTAGTACATGACCACTTGA |
| 272 | GTACGCGCTGGTCCCGTATCATGTGCGTCA | 472 | TAGGGAAGAGAAGGACATATGATGTACGCGCTGGTCCCGTATCATGTGCGTCATTGACTAGTACATGACCACTTGA |
| 273 | GGCCTCGATGGATGTGGTGGTGCTGTCA | 473 | TAGGGAAGAGAAGGACATATGATGGCCTCGATGGATGTGGTGGTGCTGTCATTGACTAGTACATGACCACTTGA |
| 274 | GGCCGAACTGGATGGGGCATTACTGCGGC | 474 | TAGGGAAGAGAAGGACATATGATGGCCGAACTGGATGGGGCATTACTGCGGCTTGACTAGTACATGACCACTTGA |
| 275 | GTCACGGAACGAAGCCTATCAAGTGCGACA | 475 | TAGGGAAGAGAAGGACATATGATGTCACGGAACGAAGCCTATCAAGTGCGACATTGACTAGTACATGACCACTTGA |
| 276 | GGCACGGAGGATGGACGTTCTGCCTTGGTC | 476 | TAGGGAAGAGAAGGACATATGATGGCACGGAGGATGGACGTTCTGCCTTGGTCTTGACTAGTACATGACCACTTGA |

TABLE 3-continued

Aptamers against peanut antigen

| SEQ ID NO. | Unique Sequence (5'-3') | SEQ ID NO. | Full sequence including primers (5'-3') |
|---|---|---|---|
| 277 | GCAACTGCACGCATTGGACCGCACGTCACA | 477 | TAGGGAAGAGAAGGACATATGATGCAACTGCACGCATTGGACCGCACGTCACATTGACTAGTACATGACCACTTGA |
| 278 | GTGCTGAGCTGGGAGTGGTGGTGCTTTGGC | 478 | TAGGGAAGAGAAGGACATATGATGTGCTGAGCTGGGAGTGGTGGTGCTTTGGCTTGACTAGTACATGACCACTTGA |
| 279 | GTCTGCCGATGGATTGGTGTACGCAGACG | 479 | TAGGGAAGAGAAGGACATATGATGTCTGCCGATGGATGTGGTGTACGCAGACGTTGACTAGTACATGACCACTTGA |
| 280 | GTACACGATGCACCTTCAAGTTGTGATGTA | 480 | TAGGGAAGAGAAGGACATATGATGTACACGATGCACCTTCAAGTTGTGATGTATTGACTAGTACATGACCACTTGA |
| 281 | GGACGCGTCGACCTTCAAGTGTGCCGTGGA | 481 | TAGGGAAGAGAAGGACATATGATGGACGCGTCGACCTTCAAGTGTGCCGTGGATTGACTAGTACATGACCACTTGA |
| 282 | GTCATTCGCTGGATGTGTTGATGTCTGGTC | 482 | TAGGGAAGAGAAGGACATATGATGTCATTCGCTGGATGTGTTGATGTCTGGTCTTGACTAGTACATGACCACTTGA |
| 283 | CGCATGGGACGTACTGACCGGATCGTGTCA | 483 | TAGGGAAGAGAAGGACATATGATCGCATGGGACGTACTGACCGGATCGTGTCATTGACTAGTACATGACCACTTGA |
| 284 | GGCCACGATGGATGAGGACATGACTGGTTG | 484 | TAGGGAAGAGAAGGACATATGATGGCCACGATGGATGAGGACATGACTGGTTGTTGACTAGTACATGACCACTTGA |
| 285 | GTGCGACACGTGTTCCCGTTCAAGTTGGGC | 485 | TAGGGAAGAGAAGGACATATGATGTGCGACACGTGTTCCCGTTCAAGTTGGGCTTGACTAGTACATGACCACTTGA |
| 286 | CACGACAGCGTTAGCAGGCCATGCGACACG | 486 | TAGGGAAGAGAAGGACATATGATCACGACAGCGTTAGCAGGCCATGCGACACGTTGACTAGTACATGACCACTTGA |
| 287 | GTCGTGCGTGCCCTATCAAGTCGGTCTGTA | 487 | TAGGGAAGAGAAGGACATATGATGTCGTGCGTGCCCTATCAAGTCGGTCTGTATTGACTAGTACATGACCACTTGA |
| 288 | GGCATGCGATGGGTGTGTTCTGGCGACGGC | 488 | TAGGGAAGAGAAGGACATATGATGGCATGCGATGGGTGTGTTCTGGCGACGGCTTGACTAGTACATGACCACTTGA |
| 289 | GTCTGAGCGCAACCTCGTGGACTGTGCGTG | 489 | TAGGGAAGAGAAGGACATATGATGTCTGAGCGCAACCTCGTGGACTGTGCGTGTTGACTAGTACATGACCACTTGA |
| 290 | GGCCGCGTCTGGATGTGGTTTTGTCGCGTC | 490 | TAGGGAAGAGAAGGACATATGATGGCCGCGTCTGGATGTGGTTTTGTCGCGTCTTGACTAGTACATGACCACTTGA |
| 291 | CCGTGTTGCGTGTCCAGTCTCGTTGCGCG | 491 | TAGGGAAGAGAAGGACATATGATCCGTGTTGCGTGTCCAGTCTCGTTGCGCGTTGACTAGTACATGACCACTTGA |
| 292 | GGCCGGCGATGGATGTGGTTGTGCTTGTTT | 492 | TAGGGAAGAGAAGGACATATGATGGCCGGCGATGGATGTGGTTGTGCTTGTTTTGACTAGTACATGACCACTTGA |
| 293 | GTGCGATACATCCCAACCTCCCGTGTGGC | 493 | TAGGGAAGAGAAGGACATATGATGTGCGATACATCCCAACCTCCCGTGTGGCTTGACTAGTACATGACCACTTGA |
| 294 | GCCGCAACGACTGAGGGGTGTATGTACGCG | 494 | TAGGGAAGAGAAGGACATATGATGCCGCAACGACTGAGGGGTGTATGTACGCGTTGACTAGTACATGACCACTTGA |
| 295 | GGACGCGGATGAGCTTCGAGTGACGTGTAC | 495 | TAGGGAAGAGAAGGACATATGATGGACGCGGATGAGCTTCGAGTGACGTGTACTTGACTAGTACATGACCACTTGA |
| 296 | GTCGTGACTGGCGTAGCTGGTAGTGCTAGG | 496 | TAGGGAAGAGAAGGACATATGATGTCGTGACTGGCGTAGCTGGTAGTGCTAGGTTGACTAGTACATGACCACTTGA |

TABLE 4

Aptamers against tree nut antigen

| SEQ ID NO. | Unique Sequence (5'-3') | SEQ ID NO. | Full sequence including primers (5'-3') |
|---|---|---|---|
| 497 | GTCATTCCGCATCCTACACGTGGGCACGTA | 597 | TAGGGAAGAGAAGGACATATGATGTCATTCCGCATCCTACACGTGGGCACGTATTGACTAGTACATGACCACTTGA |
| 498 | GGCATGCACGCACCTACAGTGGGTATGGA | 598 | TAGGGAAGAGAAGGACATATGATGGCATGCACGCACCTACACGTGGGTATGGATTGACTAGTACATGACCACTTGA |

TABLE 4-continued

Aptamers against tree nut antigen

| SEQ ID NO. | Unique Sequence (5'-3') | SEQ ID NO. | Full sequence including primers (5'-3') |
|---|---|---|---|
| 499 | GGCCTGCGATGGATGTGTGCGTGTATTAGC | 599 | TAGGGAAGAGAAGGACATATGATGGCCTGCGATGGATGTGTGCGTGTATTAGCTTGACTAGTACATGACCACTTGA |
| 500 | GCACGACTCGCACCCTATCATGAGGCCATG | 600 | TAGGGAAGAGAAGGACATATGATGCACGACTCGCACCCTATCATGAGGCCATGTTGACTAGTACATGACCACTTGA |
| 501 | GTCATGCCATCCCTTCGAGTGTGACAGGTA | 601 | TAGGGAAGAGAAGGACATATGATGTCATGCCATCCCTTCGAGTGTGACAGGTATTGACTAGTACATGACCACTTGA |
| 502 | GGCCTGCGATGGATGAGGTGCTGCACTAGT | 602 | TAGGGAAGAGAAGGACATATGATGGCCTGCGATGGATGAGGTGCTGCACTAGTTTGACTAGTACATGACCACTTGA |
| 503 | GGACGCAGCTTGCCTACTGGTGGTCACGTA | 603 | TAGGGAAGAGAAGGACATATGATGGACGCAGCTTGCCTACTGGTGGTCACGTATTGACTAGTACATGACCACTTGA |
| 504 | GGCCAATGCGCCCCTTCATGTTGTCGTGTA | 604 | TAGGGAAGAGAAGGACATATGATGGCCAATGCGCCCCTTCATGTTGTCGTGTATTGACTAGTACATGACCACTTGA |
| 505 | GTGCGCACGATGGATGTGGATGGCCAGTCT | 605 | TAGGGAAGAGAAGGACATATGATGTGCGCACGATGGATGTGGATGGCCAGTCTTTGACTAGTACATGACCACTTGA |
| 506 | GTCATGCGCGGACATTCAAGTTGGCGTGGA | 606 | TAGGGAAGAGAAGGACATATGATGTCATGCGCGGACATTCAAGTTGGCGTGGATTGACTAGTACATGACCACTTGA |
| 507 | CCGCACGTAGCCCTATCAGTGGTGCATGCA | 607 | TAGGGAAGAGAAGGACATATGATCCGCACGTAGCCCTATCAGTGGTGCATGCATTGACTAGTACATGACCACTTGA |
| 508 | GGCATGCGCTGGGTAGTGATCACGTACGGGT | 608 | TAGGGAAGAGAAGGACATATGATGGCATGCGCTGGGTAGTGATCACGTACGGTTTGACTAGTACATGACCACTTGA |
| 509 | GGCCTGCGATGGATGTGGGCTAGTATGGGC | 609 | TAGGGAAGAGAAGGACATATGATGGCCTGCGATGGATGTGGGCTAGTATGGGCTTGACTAGTACATGACCACTTGA |
| 510 | GTGCGACCGACCCTATCAGGTGCTCATGTA | 610 | TAGGGAAGAGAAGGACATATGATGTGCGACCGACCCTATCAGGTGCTCATGTATTGACTAGTACATGACCACTTGA |
| 511 | GTACTGCACTGCCCTACACGTGGGAATGGA | 611 | TAGGGAAGAGAAGGACATATGATGTACTGCACTGCCCTACACGTGGGAATGGATTGACTAGTACATGACCACTTGA |
| 512 | GGCCGACCTGGATGTGAGCATGCATCTAGT | 612 | TAGGGAAGAGAAGGACATATGATGGCCGACCTGGATGTGAGCATGCATCTAGTTTGACTAGTACATGACCACTTGA |
| 513 | CGCACCGTCGATACGTCATGCACGCTGACA | 613 | TAGGGAAGAGAAGGACATATGATCGCACCGTCGATACGTCATGCACGCTGACATTGACTAGTACATGACCACTTGA |
| 514 | GGCATGCGATGGATGGGGGCTGGGGCAGTC | 614 | TAGGGAAGAGAAGGACATATGATGGCATGCGATGCGATGGATGGGGGCTGGGGCAGTCTTGACTAGTACATGACCACTTGA |
| 515 | GACGGTGCGTCCTAAAGTGCTCAGTGCGTG | 615 | TAGGGAAGAGAAGGACATATGATGACGGTGCGTCCTAAAGTGCTCAGTGCGTGTTGACTAGTACATGACCACTTGA |
| 516 | GTACGCATCGTCCCGTCATGTGGTTCCGTA | 616 | TAGGGAAGAGAAGGACATATGATGTACGCATCGTCCCGTCATGTGGTTCCGTATTGACTAGTACATGACCACTTGA |
| 517 | GTGCGACCTGACCTAGCAAGCGGTAGTGTA | 617 | TAGGGAAGAGAAGGACATATGATGTGCGACCTGACCTAGCAAGCGGTAGTGTATTGACTAGTACATGACCACTTGA |
| 518 | GTACGACGCGGACCTTCAAGTAGGCGTGTA | 618 | TAGGGAAGAGAAGGACATATGATGTACGACGCGGACCTTCAAGTAGGCGTGTATTGACTAGTACATGACCACTTGA |
| 519 | GGCCAAGCTGACCGTAAAGGCAGGCAGTGTA | 619 | TAGGGAAGAGAAGGACATATGATGGCCAAGCTGACCGTAAAGGCAGGCGTGTATTGACTAGTACATGACCACTTGA |
| 520 | GTACGCGACGTCCCTGAGAGTGTGCAGGTA | 620 | TAGGGAAGAGAAGGACATATGATGTACGCGACGTCCCTGAGAGTGTGCAGGTATTGACTAGTACATGACCACTTGA |
| 521 | GTCAGTCGATGGATGTGGGTTGTGCTCGTC | 621 | TAGGGAAGAGAAGGACATATGATGTCAGTCGATGGATGTGGGTTGTGCTCGTCTTGACTAGTACATGACCACTTGA |
| 522 | CGCACCGTCAAGCGGGAAGGCACTTTGGTG | 622 | TAGGGAAGAGAAGGACATATGATCGCACCGTCAAGCGGGAAGGCACTTTGGTGTTGACTAGTACATGACCACTTGA |
| 523 | GGACGCACGCAGACCTTCAAGTCGGCCATG | 623 | TAGGGAAGAGAAGGACATATGATGGACGCACGCAGACCTTCAAGTCGGCCATGTTGACTAGTACATGACCACTTGA |

TABLE 4-continued

Aptamers against tree nut antigen

| SEQ ID NO. | Unique Sequence (5'-3') | SEQ ID NO. | Full sequence including primers (5'-3') |
|---|---|---|---|
| 524 | CCGTAGCGACATCAAGCGGTGGTGTGCGTG | 624 | TAGGGAAGAGAAGGACATATGATCCGTAGCGACATCAAGCGGTGGTGTGCGTGTTGACTAGTACATGACCACTTGA |
| 525 | GTGCGCGGCTTGCCTTCACGTGATCGTGTA | 625 | TAGGGAAGAGAAGGACATATGATGTGCGCGGCTTGCCTTCACGTGATCGTGTATTGACTAGTACATGACCACTTGA |
| 526 | GGCCTGATCGAACCTAGAGAGTGGCGTGGA | 626 | TAGGGAAGAGAAGGACATATGATGGCCTGATCGAACCTAGAGAGTGGCGTGGATTGACTAGTACATGACCACTTGA |
| 527 | GGACGCATCGCCCCTTCGAGTGGACAGGTA | 627 | TAGGGAAGAGAAGGACATATGATGGACGCATCGCCCCTTCGAGTGGACAGGTATTGACTAGTACATGACCACTTGA |
| 528 | GTACGCACGATGAGCGCCAAGTGACATGGA | 628 | TAGGGAAGAGAAGGACATATGATGTACGCACGATGAGCGCCAAGTGACATGGATTGACTAGTACATGACCACTTGA |
| 529 | GGCATGCGATGGATGTGGTGTACCCAGTCC | 629 | TAGGGAAGAGAAGGACATATGATGGCATGCGATGGATGTGGTGTACCCAGTCCTTGACTAGTACATGACCACTTGA |
| 530 | GGACGGAACGTGAGGGCAAGTACGTGCTCG | 630 | TAGGGAAGAGAAGGACATATGATGGACGGAACGTGAGGGCAAGTACGTGCTCGTTGACTAGTACATGACCACTTGA |
| 531 | CCATCGCGTCACATCATGTGTGTCACTGC | 631 | TAGGGAAGAGAAGGACATATGATCCATCGCGTCACTATCATGTGTGTCACGTATTGACTAGTACATGACCACTTGA |
| 532 | GTCGTGACTGGCTAGCTGGACATGCACTGC | 632 | TAGGGAAGAGAAGGACATATGATGTCGTGACTGGCTAGCTGGACATGCACTGCTTGACTAGTACATGACCACTTGA |
| 533 | GGACTGCGCGTGACCTATCAATGGCATGTA | 633 | TAGGGAAGAGAAGGACATATGATGGACTGCGCGTGACCTATCAATGGCATGTATTGACTAGTACATGACCACTTGA |
| 534 | GACCTGACTGTGCCTATCGAGTGCGTGATG | 634 | TAGGGAAGAGAAGGACATATGATGACCTGACTGTGCCTATCGAGTGCGTGATGTTGACTAGTACATGACCACTTGA |
| 535 | AATGCGGCATGAACGGACCTACACGTGGGC | 635 | TAGGGAAGAGAAGGACATATGATAATGCGGCATGAACGGACCTACACGTGGGCTTGACTAGTACATGACCACTTGA |
| 536 | GCATTGGACGATCGTGCCCTACACGTGGGC | 636 | TAGGGAAGAGAAGGACATATGATGCATTGGACGATCGTGCCCTACACGTGGGCTTGACTAGTACATGACCACTTGA |
| 537 | GGCCACACGCTGCCCTAAAGTGTTCGTGTA | 637 | TAGGGAAGAGAAGGACATATGATGGCCACACGCTGCCCTAAAGTGTTCGTGTATTGACTAGTACATGACCACTTGA |
| 538 | GTACGGAACGGAACAACAAGGGCAGGCATG | 638 | TAGGGAAGAGAAGGACATATGATGTACGGAACGGAACAACAAGGGCAGGCATGTTGACTAGTACATGACCACTTGA |
| 539 | GGCCAGATCGACATAGCGAGTGAGAGTGTA | 639 | TAGGGAAGAGAAGGACATATGATGGCCAGATCGACATAGCGAGTGAGAGTGTATTGACTAGTACATGACCACTTGA |
| 540 | GTCATGCGCGTACCATCGAGGGGGCGTGGA | 640 | TAGGGAAGAGAAGGACATATGATGTCATGCGCGTACCATCGAGGGGGCGTGGATTGACTAGTACATGACCACTTGA |
| 541 | GCACGCCGATGCCCTCATGTGGCCGTGGA | 641 | TAGGGAAGAGAAGGACATATGATGCACGCCGATGCCCTCATGTGGCCGTGGATTGACTAGTACATGACCACTTGA |
| 542 | GCACTGAGCGTACGTATCAGCGGGCACGTA | 642 | TAGGGAAGAGAAGGACATATGATGCACTGAGCGTACGTATCAGCGGGCACGTATTGACTAGTACATGACCACTTGA |
| 543 | GTGCTGAGCTGGGAGTGGTGGTGCTTTGGC | 643 | TAGGGAAGAGAAGGACATATGATGTGCTGAGCTGGGAGTGGTGGTGCTTTGGCTTGACTAGTACATGACCACTTGA |
| 544 | GTGCTGCGATGGATTGGGAGTGTCTTTGGC | 644 | TAGGGAAGAGAAGGACATATGATGTGCTGCGATGGATTGGGAGTGTCTTTGGCTTGACTAGTACATGACCACTTGA |
| 545 | GTACGCGGCTGGATACAAGTACGGCATGGA | 645 | TAGGGAAGAGAAGGACATATGATGTACGCGGCTGGATACAAGTACGGCATGGATTGACTAGTACATGACCACTTGA |
| 546 | GGACGCGATGGATGTGGACGGTGTGGTAGT | 646 | TAGGGAAGAGAAGGACATATGATGGACGCGATGGATGTGGACGGTGTGGTAGTTTGACTAGTACATGACCACTTGA |
| 547 | GTCATGCACGAACACTATCATGGCGGCATG | 647 | TAGGGAAGAGAAGGACATATGATGTCATGCACGAACACTATCATGGCGGCATGTTGACTAGTACATGACCACTTGA |
| 548 | GTCATGCTCGCACTATCAGGTGTGCATGGA | 648 | TAGGGAAGAGAAGGACATATGATGTCATGCTCGCACTATCAGGTGTGCATGGATTGACTAGTACATGACCACTTGA |

TABLE 4-continued

Aptamers against tree nut antigen

| SEQ ID NO. | Unique Sequence (5'-3') | SEQ ID NO. | Full sequence including primers (5'-3') |
|---|---|---|---|
| 549 | GGCCTGACTGGGTGTGGTTAGGAACGCGTC | 649 | TAGGGAAGAGAAGGACATATGATGGCCTGACTGGGTGTGGTTAGGAACGCGTCTTGACTAGTACATGACCACTTGA |
| 550 | GTGCTCGCAAGACCTACACGTGGACGTGGA | 650 | TAGGGAAGAGAAGGACATATGATGTGCTCGCAAGACCTACACGTGGACGTGGATTGACTAGTACATGACCACTTGA |
| 551 | GGCACAAACGGACCGACAAGTGCGCATGGA | 651 | TAGGGAAGAGAAGGACATATGATGGCACAAACGGACCGACAAGTGCGCATGGATTGACTAGTACATGACCACTTGA |
| 552 | TCGATCGATCCGTCAAGCAGGCACGTGTCA | 652 | TAGGGAAGAGAAGGACATATGATTCGATCGATCCGTCAAGCAGGCACGTGTCATTGACTAGTACATGACCACTTGA |
| 553 | GGCATTGCGCGCCTAGCAAGTTGACGTGTA | 653 | TAGGGAAGAGAAGGACATATGATGGCATTGCGCGCCTAGCAAGTTGACGTGTATTGACTAGTACATGACCACTTGA |
| 554 | GGACGCGTCGACTTCAAGTGTGCCGTGGA | 654 | TAGGGAAGAGAAGGACATATGATGGACGCGTCGACCTTCAAGTGTGCCGTGGATTGACTAGTACATGACCACTTGA |
| 555 | CCGCATCGGACCGATCAAGGCAGGCTTGGA | 655 | TAGGGAAGAGAAGGACATATGATCCGCATCGGACCGATCAAGGCAGGCTTGGATTGACTAGTACATGACCACTTGA |
| 556 | TGGCCAAGCGACCTAGCAAGTGTGCTCATG | 656 | TAGGGAAGAGAAGGACATATGATTGGCCAAGCGACCTAGCAAGTGTGCTCATGTTGACTAGTACATGACCACTTGA |
| 557 | GGCATGCGATGAACGAGGCATGATGCGTCA | 657 | TAGGGAAGAGAAGGACATATGATGGCATGCGATGAACGAGGCATGATGCGTCATTGACTAGTACATGACCACTTGA |
| 558 | GTACGACGCGAGCTAGCAAGGAGGCGTGTA | 658 | TAGGGAAGAGAAGGACATATGATGTACGACGCGAGCTAGCAAGGAGGCGTGTATTGACTAGTACATGACCACTTGA |
| 559 | GGCATGCACGCACCTACACGTGGGCACGTA | 659 | TAGGGAAGAGAAGGACATATGATGGCATGCACGCACCTACACGTGGGCACGTATTGACTAGTACATGACCACTTGA |
| 560 | CCATATGGCAGTGCGATGGCTTCGCTGGTC | 660 | TAGGGAAGAGAAGGACATATGATCCATATGGCAGTGCGATGGCTTCGCTGGTCTTGACTAGTACATGACCACTTGA |
| 561 | GTCATGCGCTGGGTGTGGCCTGTTGTAGGC | 661 | TAGGGAAGAGAAGGACATATGATGTCATGCGCTGGGTGTGGCCTGTTGTAGGCTTGACTAGTACATGACCACTTGA |
| 562 | GTGCTGCCTGACCCACGTGGACTTGCACTA | 662 | TAGGGAAGAGAAGGACATATGATGTGCTGCCTGACCCACGTGGACTTGCACTATTGACTAGTACATGACCACTTGA |
| 563 | GGACTGACGAGCCGTTCATGTGGTTGTGGA | 663 | TAGGGAAGAGAAGGACATATGATGGACTGACGAGCCGTTCATGTGGTTGTGGATTGACTAGTACATGACCACTTGA |
| 564 | CGCAACGGTGACGAGCAGTGAGTGCATGTA | 664 | TAGGGAAGAGAAGGACATATGATCGCAACGGTGACGAGCAGTGAGTGCATGTATTGACTAGTACATGACCACTTGA |
| 565 | GGACGGATCGAACCTACAAGTTGTCGTGGA | 665 | TAGGGAAGAGAAGGACATATGATGGACGGATCGAACCTACAAGTTGTCGTGGATTGACTAGTACATGACCACTTGA |
| 566 | GTCGTGAGCTGGAAGGAGAGTGGGTACGTA | 666 | TAGGGAAGAGAAGGACATATGATGTCGTGAGCTGGAAGGAGAGTGGGTACGTATTGACTAGTACATGACCACTTGA |
| 567 | GTCATTGTCGGATGTGAGCATGTTTCTCGGC | 667 | TAGGGAAGAGAAGGACATATGATGTCATTGTCGGATGTGAGCATGTTCTCGGCTTGACTAGTACATGACCACTTGA |
| 568 | GCGTGTCAGCAATACGTCCTCATCTGCCCG | 668 | TAGGGAAGAGAAGGACATATGATGCGTGTCAGCAATACGTCCTCATCTGCCCGTTGACTAGTACATGACCACTTGA |
| 569 | GTCACGGAACGAAGCCTATCAAGTGCGACA | 669 | TAGGGAAGAGAAGGACATATGATGTCACGGAACGAAGCCTATCAAGTGCGACATTGACTAGTACATGACCACTTGA |
| 570 | GCGACAGCGACATACGATCTGCTCTGCGTC | 670 | TAGGGAAGAGAAGGACATATGATGCGACAGCGACATACGATCTGCTCTGCGTCTTGACTAGTACATGACCACTTGA |
| 571 | GTTCGCGCGACACCTATCAATGTGGACGTG | 671 | TAGGGAAGAGAAGGACATATGATGTTCGCGCGACACCTATCAATGTGGACGTGTTGACTAGTACATGACCACTTGA |
| 572 | GACACGCCGATGAGCCTAGCCTGTACGACG | 672 | TAGGGAAGAGAAGGACATATGATGACACGCCGATGAGCCTAGCCTGTACGACGTTGACTAGTACATGACCACTTGA |
| 573 | GGCCGAACTGGATGGGGCATTACTGCGGC | 673 | TAGGGAAGAGAAGGACATATGATGGCCGAACTGGATGGGGCATTACTGCGGCTTGACTAGTACATGACCACTTGA |

TABLE 4-continued

Aptamers against tree nut antigen

| SEQ ID NO. | Unique Sequence (5'-3') | SEQ ID NO. | Full sequence including primers (5'-3') |
|---|---|---|---|
| 574 | GTACGCCTCGGAGCTAGCAGGTGGTGTGGA | 674 | TAGGGAAGAGAAGGACATATGATGTACGCCTCGGAGCTAGCAGGTGGTGTGGATTGACTAGTACATGACCACTTGA |
| 575 | GGCCAAGCTGGATGTGTTCAGGTCACGACG | 675 | TAGGGAAGAGAAGGACATATGATGGCCAAGCTGGATGTGTTCAGGTCACGACGTTGACTAGTACATGACCACTTGA |
| 576 | GTCATGCTCTGGGTGTGCGAATGTGGTAGG | 676 | TAGGGAAGAGAAGGACATATGATGTCATGCTCTGGGTGTGCGAATGTGGTAGGTTGACTAGTACATGACCACTTGA |
| 577 | GTCACTGTGCCTGACCGTCAAGTTGCGGCA | 677 | TAGGGAAGAGAAGGACATATGATGTCACTGTGCCTGACCGTCAAGTTGCGGCATTGACTAGTACATGACCACTTGA |
| 578 | CGACGCAATCGGACACTGGACATGCGCAGA | 678 | TAGGGAAGAGAAGGACATATGATCGACGCAATCGGACACTGGACATGCGCAGATTGACTAGTACATGACCACTTGA |
| 579 | GCACGTACGCCTTGCCTATCTGTGCTCATG | 679 | TAGGGAAGAGAAGGACATATGATGCACGTACGCCTTGCCTATCTGTGCTCATGTTGACTAGTACATGACCACTTGA |
| 580 | GTGCGCCGATATCCCTTCACAGTTGGCATG | 680 | TAGGGAAGAGAAGGACATATGATGTGCGCCGATATCCCTTCACAGTTGGCATGTTGACTAGTACATGACCACTTGA |
| 581 | CATGTGTCGACTCGCCCTATCATGCGGTCA | 681 | TAGGGAAGAGAAGGACATATGATCATGTGTCGACTCGCCCTATCATGCGGTCATTGACTAGTACATGACCACTTGA |
| 582 | GGACGCACATCCCGTTCATGTGTGCATGTA | 682 | TAGGGAAGAGAAGGACATATGATGGACGCACATCCCGTTCATGTGTGCATGTATTGACTAGTACATGACCACTTGA |
| 583 | GGACTCGCGTCACTATCACGGGGGCAGGTA | 683 | TAGGGAAGAGAAGGACATATGATGGACTCGCGTCACTATCACGGGGGCAGGTATTGACTAGTACATGACCACTTGA |
| 584 | GCTTCGATGGATGCTGGGCAGGCACGCAGT | 684 | TAGGGAAGAGAAGGACATATGATGCTTCGATGGATGCTGGGCAGGCACGCAGTTTGACTAGTACATGACCACTTGA |
| 585 | GACATTCGCTGGATGTGGGGATGCACTGTC | 685 | TAGGGAAGAGAAGGACATATGATGACATTCGCTGGATGTGGGGATGCACTGTCTTGACTAGTACATGACCACTTGA |
| 586 | TGGCCGATCGACCCTATCAAGTGCAGCATG | 686 | TAGGGAAGAGAAGGACATATGATTGGCCGATCGACCCTATCAAGTGCAGCATGTTGACTAGTACATGACCACTTGA |
| 587 | GTGCGACCGACCCTATCAAGTACGTCA | 687 | TAGGGAAGAGAAGGACATATGATGTGCGACCGACCCTATCAAGTACGTCATTGACTAGTACATGACCACTTGA |
| 588 | GTGCTGAACGTACCGATTCAAGTGTGCGTG | 688 | TAGGGAAGAGAAGGACATATGATGTGCTGAACGTACCGATTCAAGTGTGCGTGTTGACTAGTACATGACCACTTGA |
| 589 | GGCCTGCGATGGAATGTGCGAATGTACGCA | 689 | TAGGGAAGAGAAGGACATATGATGGCCTGCGATGGAATGTGCGAATGTACGCATTGACTAGTACATGACCACTTGA |
| 590 | CTCATGCGGACCGAACTGGATGTGTGCATG | 690 | TAGGGAAGAGAAGGACATATGATCTCATGCGGACCGAACTGGATGTGTGCATGTTGACTAGTACATGACCACTTGA |
| 591 | GTTCTGACTGGTGTGGTGCTGCACTGTCA | 691 | TAGGGAAGAGAAGGACATATGATGTTCTGACTGGGTGTGGTGCTGCACTGTCATTGACTAGTACATGACCACTTGA |
| 592 | GTCGTGCGTGCCCTATCAAGTCGGTCTGTA | 692 | TAGGGAAGAGAAGGACATATGATGTCGTGCGTGCCCTATCAAGTCGGTCTGTATTGACTAGTACATGACCACTTGA |
| 593 | GGCCGAATGACCGTCTCATGTGAGCATGGA | 693 | |
| 594 | GGTCCGAACGCACCTCATGTGTGTCGTGTA | 694 | |
| 595 | GGTCTGCGCGTACCGTCAAGTGCGAATGGA | 695 | |
| 596 | GTCGTGAGCGGGTGTGGGACTGGACGCAGT | 696 | |

4. SPN-Complement Complexes

In some embodiments, SPN-complement complexes are provided. A nucleic acid sequence that is complementary to a portion of the sequence of a signaling polynucleotide (SPN) (e.g., either the 5'end or 3'end sequence of the SPN) is hybridized with the corresponding SPN sequence, forming a SPN-complement complex. In some aspects, the complementary sequence may contain about 5 to 20 nucleotide residues, or about 5 to 10 nucleotide residues, or about 10 to 15 nucleotide residues, or about 10-20 nucleotide residues. In particular, it may contain 5, 6, 7, 8, 9, 10, 11, 12, 13, 14, 15, 16, 17, 18, 19, or 20 nucleotide residues. In one embodiment, the complementary sequence contains 5 nucleotide residues. In another embodiment, the complementary sequence contains 10 nucleotide residues. In some aspects, the complementary sequence may be at least 100% complementary to the SPN sequence, or at least 99% complementary to the SPN sequence, or at least 95% complementary to the SPN sequence, or at least 90% complementary to the SPN sequence, or least 80% complementary to the SPN sequence. In another embodiment, the complementary sequence may have additional polyA nucleotides. The short complementary sequence can easily detach from the corresponding SPN, in particular when a target allergen protein competes and binds to the SPN, enabling a highly sensitive detection assay.

In some aspects, the complementary sequence is labeled with a detection signal moiety e.g., a fluorophore, at either the 5'end or 3'end of the sequence. As non-limiting examples, the fluorophore may be selected from Alex Fluor® @ fluorophores (such as Alex 514, Alex 532, Alex 546, Alex 555, Alex 568, Alex 594, Alex 610, Alex 633, Alex 635, Alex 647, Alex 660, Alex 680, Alexa 700, Alex 750, Alex 800, Alex 610-R-phycoerythrin (R-PE), Alex 647-R-phycoerythrin (R-PE), Alex 680-R-phycoerythrin (R-PE), and Alex 680-Allophycocyanin (APC)), Allophycocyanin (APC) and its derivatives, Cy fluorophores (e.g., Cy3.5, Cy3-FITC, CY5, CY 5.5, CY7, CY7-APC, CY5.5-APC), Qdots, TRITC, R-PE, Tamara, Rhodamine Red-X, Rox, TruRed, SYPRO red, BODIPY TR, Propidium iodide and Texas red. In some examples, the fluorophore is Alex 647, Cy5, Cy3-FITC or Texas red.

Detection Agents

Aptamers, signaling polynucleotides (SPNs) and SPN-complement complexes can be used as detection agents in a variety of allergen detection assays, biosensors, detection systems and devices as disclosed in the prior art, either as free agents or conjugates to other support substances. For example, aptamers, SPNs and SPN-complement complexes of the present invention may be used as surface bound affinity molecules that bind the surfaces of solid substrates. The solid surface may be a three-dimensional surface such as micro-spheres (e.g., magnetic beads/particles), or a two-dimensional surface such as the glass or silicon surface.

In one embodiment, aptamers, SPNs and SPN-complement complexes of the present invention are immobilized on the surface of magnetic particles to form functionalized magnetic particles which can capture a target analyte (e.g., allergen) in a fluid sample; the particles will be suitable for magnetic manipulations in a detection assay and method.

In some aspects, aptamers, SPNs and SPN-complement complexes of the present invention may be covalently immobilized on the surface of magnetic particles. In some aspects, SPNs may be covalently immobilized on the surface of magnetic particles through an amine (—NH2) group, or a thiol group (—SH) at one end the SPN sequence. In other aspects, complementary sequence of SPNs may be covalently immobilized on the surface of magnetic particles, from which the SPNs are attached to the particles. Concentrations of SPNs, complementary sequences and magnetic particles are optimized for the most effective binding to each other. In some aspects, SPNs and their complementary sequences may be at a ratio of 1:5, or at a ratio of 1:4, or at a ratio of 1:3, or at a ratio of 1:2.

In another embodiment, aptamers, SPNs and SPN-complement complexes of the present invention may be attached to a two-dimensional solid surface; said two dimensional solid surface may be a glass surface or the surface of a silicon chip. Such surfaces printed/coated with aptamers, SPNs, complements and/or SPN-complement complexes of the present invention may be used as biosensing platforms for a variety of assays and applications.

Figure 4A:
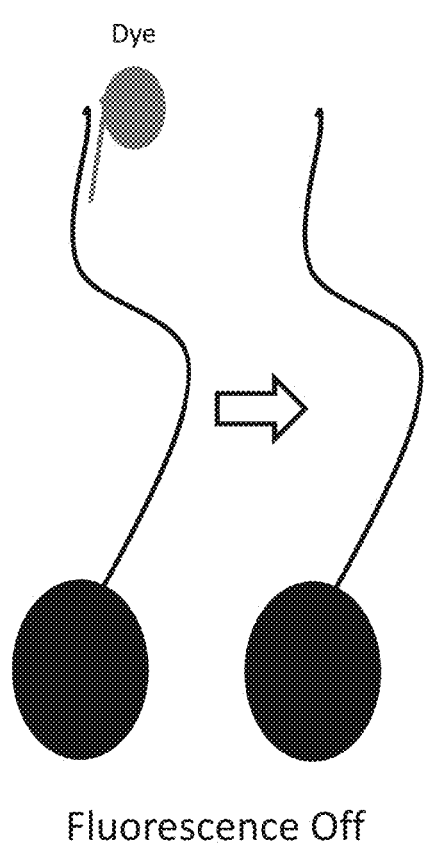
FIG. 4A, FIG. 4B and FIG. 4C demonstrate fluorescence off; fluorescence on and dual dye configurations of SPN-complement complexes, respectively.
Figure 4B:
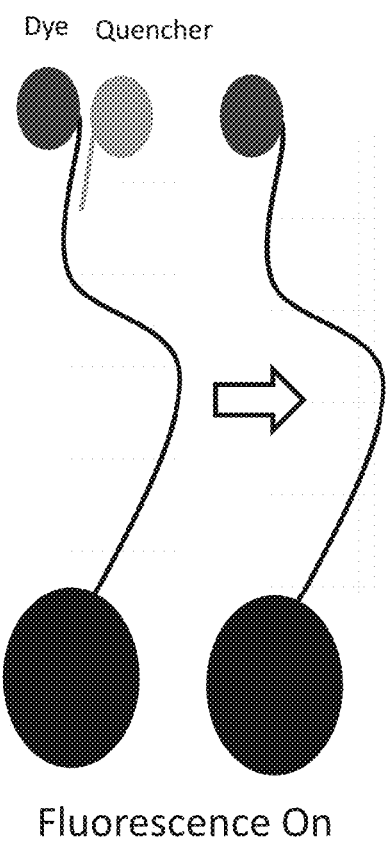
Figure 4C:
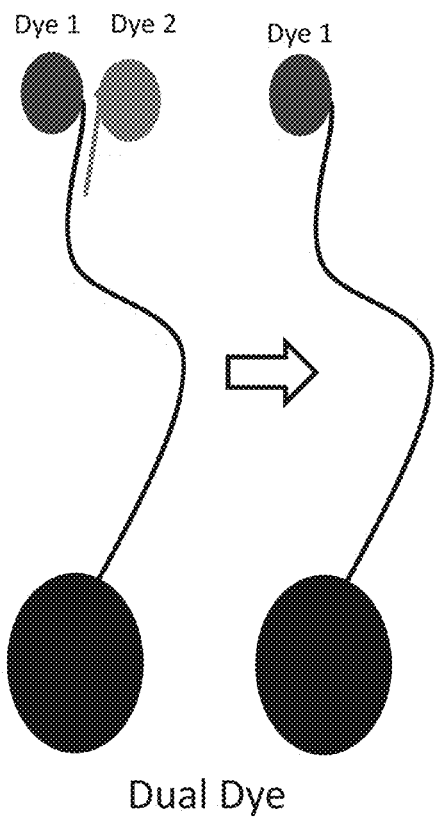

In some embodiments, detection agents of the present invention may be labeled with a fluorescent marker which generates detectable fluorescent signals. Either the SPN or its complementary sequence may be labeled with a fluorophore. In some aspects, the fluorophore is added to one end of the complement sequence, either the 5'end or 3'end, as illustrated in FIGS. 4A, 4B and 4C, and FIG. 5A. In other aspects, One end of the SPN may be labeled with a fluorophore, as shown in FIG. 5B. FIG. 6A and FIG. 6B. As non-limiting examples, the fluorophore may be selected from, Alex Fluor®, fluorophores (such as Alex 514, Alex 532, Alex 546, Alex 555, Alex 568, Alex 594, Alex 610, Alex 633, Alex 635, Alex 647, Alex 660, Alex 680, Alexa 700, Alex 750, Alex 800, Alex 610-R-phycoerythrin (R-PE), Alex 647-R-phycoerythrin (R-PE), Alex 680-R-phycoerythrin (R-PE), and Alex 680-Allophycocyanin (APC)), Allophycocyanin (APC) and its derivatives, Cy fluorophores (e.g., Cy3.5, Cy3-FITC, CY5, CY 5.5, CY7, CY7-APC, CY5.5-APC), Qdots, TRITC, R-PE, Tamara, Rhodamine Red-X, Rox, TruRed, SYPRO red, BODIPY TR, Propidium iodide and Texas red. In some examples, the fluorophore is Alex 647, Cy5, CY3-FITC or Texas red.

1. Magnetic Particles/Beads

Magnetic particles have several advantages that make them attractive substrates for use as signal transducers, including their biological inertness, physical stability, and the absence of competing magnetic signals in biological materials (Gijs et al., *Chem Rev.* 2010; Vol 110(3), 1518-1563).

Magnetic particles may be any particle materials that can be separated by magnetic forces. Magnetic particles for bioresearch may consist of one or more magnetic cores with a coating matrix of polymers, silica or hydroxylapatite with terminal functionalized groups. The magnetic core generally consists either of magnetite ($Fe_3O_4$) or maghemite ($\gamma$-$Fe_2O_3$) with superparamagnetic or ferromagnetic properties. For example, magnetic cores can be made with magnetic ferrites, such as cobalt ferrite or manganese ferrite. Such magnetic micro- or nanospheres can be separated easily and quickly by magnetic forces and can be used together with bioaffine ligands, e.g. antibodies or aptamers with a high affinity to the target.

In one example, magnetic particles or beads may be synthesized by dispersing ferrite crystals in a suspension of styrene, divinylbenzene monomers and polymerizing the cocktails into microparticles. In another example, magnetic particles/beads may be synthesized by coating one or more layers of magnetite onto a polystyrene core. Multiple layers of magnetite may increase the speed by which the particle/bead responds to a magnetic field. The synthesized microparticles are encapsulated with inert polymers such as polystyrene to prevent the iron from interfering with any subsequent biochemical reactions. Polystyrene magnetic beads can be used for with both carboxylic acid and amine surface chemistries.

Additional polymers that may be used to prepare magnetic particles/beads include, but are not limited to, alginate, dextran, polyacrylamide, polycaprolactone, polyethylenimine (PEI), polyisopropene, poly(2-cinnamoylethyl methacrylate), poly(acetoacetoxyethyl methacrylate), poly(dimethylsiloxane), poly(ethylene glycol)-poly(aspartic acid) (PEG-PAsp), poly(ethylene oxide), poly(glutamic acid), poly(glycidyl methacrylate), poly(lactide), poly(lactide-co-glycolide), poly(1-lactic acid), poly(l-lactide-co-glycolide), poly(methyl methacrylate-divinylbenzene), poly(N-isopropyl acrylamide) (PNIPA), poly(N-vinylcaprolactam), poly(styrene-acetoacetoxyethylmethacrylate) (PSAAEM), poly(styrene-butyl acrylate-methacrylic acid), poly(styrene-co-acrylamide), poly(styrene-co-acrylic acid), poly(styrene-co-butyl acrylate), poly(styrene-divinylbenzene-glycidyl methacrylate), poly(styrene-methacrylic acidacrylamide), poly(tert-butyl acrylate), poly(vinyl alcohol) (PVA), and any combinations thereof.

Magnetic particles may also be coated with streptavidin, maleimide, amino groups or carboxyl groups to optimize aptamer affinity. DNA specificity and non-specific adsorption of DNAs on their surfaces.

In addition to chemical modifications on the surface, magnetic particles may be in a size with maximal efficiency and affinity to the conjugated nucleic acids. As used herein, the particle size (or particle diameter) is given as a hydrodynamic diameter, which includes the core diameter and two times the diameter of the cover matrix. The size of the particle determines the surface area available for the attachment of functional groups. Increasing the size reduces the surface-to-volume ratio therefore resulting in a decrease of the available surface area per volume for modification, but speeding up its response in a magnetic field which makes it easier to be manipulated. In some examples, magnetic particles may be in a wide range of average particle sizes, from 100 nm to 5.0 µm in the diameter, having optimized parameters such as sedimentation rate, available binding sites, and magnetic volume. In some aspects, the average magnetic particle size may be from 100 nm to 800 nm, or from 200 nm to 500 nm, or from 0.1 µm to 3.0 µm, the size may be 100 nm, 125 nm, 150 nm, 200 nm, 250 nm, 300 nm, 350 nm, 400 nm, 450 nm, 500 nm, 550 nm, 600 nm, 700 nm, 800 nm, 900 nm, 0.2 µm, 0.3 µm, 0.4 µm, 0.5 µm, 0.6 µm, 0.7 µm, 0.8 µm, 0.9 µm, 1.0 µm, 1.5 µm, 2.0 µm, 2.5 µm, 3.0 µm, 3.5 µm, 4.0 µm, 4.5 µm, or 5.0 µm.

In some cases, magnetic particles may have an irregular or rough surface. As curvature can introduce additional surface area, irregular or rough surface increases the overall surface area available for the attachment of nucleic acid molecules.

As non-limiting examples, magnetic particles may be fluidMAG particles (which is hydrophilic). SiMAG particles (which are magnetic silica beads with superparamagnetic or ferromagnetic properties and possess either a highly porous or a non-porous silica surface), mHPA-particles (which are non-spherical with hydroxylapatite coated ferromagnetic particles with a diameter of 2 µm, consisting of calcium phosphate), ZeoliteMAG (which are magnetic zeolite particles, which consist of a superparamagnetic iron oxide core and a high-porous aluminosilicate matrix), beadMAG-particles (which are magnetic particles with a diameter of 1 µm, covered with a hydrophilic matrix of crosslinked starch with terminal cation-exchange phosphate groups), and magTosyl-magnetic beads or other appropriately derived magnetic beads for nucleic acid conjugations. In some embodiments, polystyrene magnetic particles may be used. The magnetic particles may also be sepharose magnetic microbeads and agarose magnetic microbeads.

In some embodiments, magnetic particles, in the absence of a magnetic field, may exhibit no net magnetization, but within a magnetic field, the magnetic moments of the bead align with the field, making the beads magnetic.

2. Other Solid Substrates

Aptamers, SPNs and/or SPN-complement complexes may be attached to any two-dimensional solid surfaces such as microtiter plates, silicon chips and printed glass surfaces (e.g. epoxy saline-derived glass surfaces). Other examples of suitable solid substrates (also called solid supports) may include, but are not limited to, those made of silica or silica-based materials, functionalized glass, modified silicon, inorganic glasses, plastics, resins, polysaccharides, carbon, metals, nylon, natural fibers such as silk, wool and cotton, and polymers. Solid substrates may have any useful form including thin films or membranes, beads, microwell plates, dishes, slides, fibers, woven fibers, shaped polymers, particles, chips, wafers and microparticles. Solid substrates may be porous or non-porous.

In some embodiments, the two-dimensional surface may be a surface of a glass or silicon slide. Glass is a readily available and inexpensive support medium that has low intrinsic fluorescence. The surface of the glass or silicon slide may be modified or unmodified, although most attachment protocols involve chemically modifying the glass surface to facilitate attachment of the oligonucleotides. Glass has a relatively homogeneous chemical surface whose properties have been well studied and is amenable to chemical modification using very versatile and well developed silanization chemistry. In certain embodiments, the surface of the glass or silicon slide is unmodified. For example, silanized oligonucleotides can be covalently linked to an unmodified glass surface (Kumar et al., *Nucleic Acids Res.* 2000 Jul. 15; 28(14): e71).

In certain embodiments, the surface of glass or silicon is chemically modified. Glass surface can be treated with an amino silane to have a uniform layer of primary amines or epoxides. In one example, oligonucleotides modified with an NH2 group can be immobilized onto epoxy silane-derivatized or isothiocyanate coated glass slides. In another example, succinylated oligonucleotides can be coupled to aminophenyl- or aminopropyl-derivitized glass slides by peptide bonds. In yet another example, disulfide-modified oligonucleotides can be immobilized onto a mercaptosilanized glass support by a thiol/disulfide exchange reactions or through chemical cross linkers.

In some embodiments, graphene oxide (GO) may be used as signal transducers in replacement of magnetic particles. Graphene oxide (GO) is a single-atom-thick two-dimensional carbon nanomaterial widely used in biosensor applications due to its unique optical electronic, thermal, and long-lasting biocompatibility properties (also known as graphene oxide nanosheet and graphene nanosheet). Most importantly. GO has superior fluorescence quenching capacity and unique adsorption characteristics for biomolecules. The quenching capacity is due to self-assembly of graphene oxide through specific π-π interactions.

GO is graphite oxidized to intersperse the carbon layers with oxygen molecules, and then reduced to separate the carbon layers completely into individual or few layer graphene. GO can be synthesized by the oxidative treatment of graphite by one of the principle methods developed by Brodie, Hummers or Staudenmeir in the art. A number of modified methods are also available (Paulchamy, et al., *J Nanomed Nanotechnol,* 2015, 6:1. doi: 10.4172/2157-7439.1000253; Jasim, et al., *2D Mater.* 2016, 3, 014006. doi: 10.1088/2053-1583/3/1/014006; and Shahriary and Athawale, *Int. J. Renew. Energy Environ. Eng,* 2014, Vol. 02 (01): 58-63; the contents of each of which are incorporated herein by reference in their entirety.)

In some embodiments, SPNs and/or SPN-complement complexes may be attached onto the GO surface through physical adsorption. In this aspect, SPNs or SPN-complement complexes may be labeled with Qdots. When Qdots-aptamer conjugates are attached onto GO, the fluorescence signal is quenched due to non-radioactive electronic excitation energy transfer between the fluorophore and GO. In the presence of a target molecule, the interaction between the target molecule and the aptamer is stronger than that between the aptamer and GO, resulting in the release of the aptamer and therefore recovery of the fluorescence signal.

3. Conjugation Chemistry and Methods

Aptamers, SPNs and SPN complementary sequences can be conjugated to magnetic particles by any method known in the art which are used to conjugate nucleic acid molecules to solid surfaces. The methods may be irreversible immobilization methods or reversible immobilization methods. As non-limiting examples, methods may include biotin-streptavidin system, and EDC mediated carboxyl-to-amine cross-linking (e.g., covalent binding of amino-modified aptamer (SPNs) to carboxyl-functionalized magnetic particles), Aldehyde-activated sugars; and cross linkers used to modify nucleic acids and solid surfaces for conjugations (Scientific, Thermo (2012), *Crosslinking Technical Handbook*, Thermo Fisher Scientific Inc., Waltham, USA).

In some embodiments, the short complementary sequences may be bound to a solid surface. In other embodiments, the SPN may be bound to a solid surface.

In some embodiments, nucleic acid molecules (e.g. aptamers, SPNs, and SPN complement) of the present invention are conjugated to the surface of magnetic particles at one end, e.g. the 5' end or 3'end (e.g., as shown in FIGS. 4A, 4B, 4C and FIG. 5B). Nucleic acids can be covalently attached to magnetic particles/beads by methods based on the formation of covalent bonds. Carboxyl and amino groups are the most common reactive groups for attaching ligands to surfaces. Examples of the reactive groups that can be incorporated on the micro-bead surface and/or the termini of ligands for covalent coupling may include but are not limited to, carboxylic acid (—COOH). Primary aliphatic amine (—RNH$_2$), Aromatic amine (—ArNH$_2$), Chloromethyl (vinyl benzyl chloride) (—ArCH$_2$CL), Amide (—CONH$_2$), Hydrazide (—CONHNH$_2$), Aldehyde (—CHO), Hydroxyl (—OH), Thiol (—SH) and Epoxy (—COC—).

In some aspects, an amino group may be attached to the 5' or 3' end of the nucleic acid sequence. Various amino modifiers such as β-cyanoethyl phosphoramidites can be added to the 5' end of a nucleic acid molecule. 5' amino modifiers can be simple amino groups with a six or twelve carbon spacers, a Uni-Link amino modifier, or amino modified thymidine or cytosine. Amino modifiers that can be added to the 3' end of a nucleic acid molecule (e.g., SPN), may be CPGs. In one example, a primary amine (—NH2) modifier may be placed to the 5'end, or 3'end of a nucleic acid molecule (e.g., SPN), or internally using an amino-C or amino-T modified base. The amino-modified nucleic acid molecules may be attached to magnetic particles using an acylating reagent, including but not limiting to Carbodiimide (EDC), Isothiocyanate, Sulfonyl chloride, and Succinimidyl esters (NHS-ester). In one aspect, amine-modified nucleic acids can then be reacted with carboxylate-modified microparticles with carbodiimide mediated acylation in a one-step coupling, which is fast and inexpensive. In addition, Acylation of a carboxyl group generates a stable carbonyl amide. One example of carbodiimide may be water soluble EDAC (1-ethyl-3-(3-dimethylaminopropyl) carbodiimide hydrochloride). Alternatively, amine-modified nucleic acids may be attached to magnetic particles with Isothiocyanates, which form thioureas linkage upon reaction with amines. The thioureas linkage is relatively stable.

In other aspects, a thiol group (e.g., thiol meliamide) is attached to the 5' or 3' end of a nucleic acid molecule (e.g., a SPN). The thiol (—SH) modifier enables covalent attachment of a nucleic acid molecule to a variety of substrates including magnetic particles, via disulfide bond (—S—S—) or maleimide linkages. The incorporation of a thiol group at the 5' end of a nucleic acid molecule may be achieved with S-trityl-6-mercaptohexyl derivatives. The 3'-thiol modifier C3 S—S CPG may be used to introduce a thiol group to the 3'-end of a nucleic acid molecule.

In one particular example, a short polyA sequence (e.g., 5 nt) may be added at the end of the SPN or the complementary sequence. The polyA tail then is modified with a thiol group. The reaction between thiol-DNA and carboxylated magnetic beads is mediated by maleimide which is attached to Poly(ethylene glycol) (PEG) polymer coated solid substrates. It is believed that the distance created by the addition of polyA residues and PEG, increases the binding between the bead and DNA and the stability of DNA on the surface of magnetic particles. At the same time, PEG linkers may reduce non-specific binding.

In some examples, cross linkers may be used to attach thiol, or amine-modified nucleic acids to the surface of magnetic beads. As used herein, the term "cross-linker" means a functional chemical group that covalently binds two distinct chemical groups and generates a physical space between the two entities which provides greater accessibility and or freedom to each of the linked biomolecules. A number of cross-linkers may be used to develop covalent attachment of thiol or amine modified nucleic acids to solid surfaces, such as succinimidyl 4-[maleimidophenyl]butyrate (SMPB).

Magnetic particles may also be coated with streptavidin, maleimide, other amino groups or carboxyl groups to optimize aptamer affinity, DNA specificity and non-specific adsorption of DNAs on their surfaces.

In one example, the coupling of nucleic acids and surfaces may be through the binding of biotin-labeled nucleic acids to streptavidin-coated beads. The biotin-streptavidin linkage can tether nucleic acid molecules to the solid surface (e.g. magnetic particles). In another example, nucleic acid molecules and/or solid substrates may be coupled by ethanolamine and heterobifunctional poly (ethylene glycol) (PEG) linkers, which allow the covalent binding of nucleic acid molecules to the solid substrates (e.g. magnetic particles and glass slides). Accordingly, magnetic beads (or other solid substrates such as glass slides) are coated with PEG polymers. PEG polymers coated magnetic particles are further modified to add an active agent such as a carboxyl group, an amine group, a maleimide and a neutravidin. The PEG linkers will change the surface force, nucleic acid stability and non-specific binding. A detailed protocol is described by Janissen et al (*Nucleic acid Research*, 2014, 42(18): e137; the contents of which are incorporated herein by reference in its entirety).

In addition to chemical modifications on the surface, magnetic beads may be in a size with maximal efficiency and affinity to the linked nucleic acids. Magnetic particles or beads may be synthesized by dispersing ferrite crystals in a suspension of styrene, divinylbenzene monomers and polymerizing the cocktails into microparticles. (Polystyrene magnetic beads can be used for with both carboxylic acid and amine surface chemistries.)

In some aspects, acid treated magnetic particles containing hydroxyl (OH) groups on the surface can be used to conjugate ligands including aptamers as disclosed in U.S. Patent application publication No.: US2014/0206822, the contents of which are incorporated herein by reference in its entirety.

In further another example, molecular spacers may be used to mediate the coupling between aptamers and magnetic particles. The method can avoid interaction between the solid surface and the aptamer conformation.

Aptamers, SPNs and SPN-complement complexes may also be conjugated to a glass surface or other two-dimensional surfaces through chemical modifications known in the art. In some aspects, the solid surface treatment may include, but is not limited to epoxy silane coated glass, isothiocyanate coated glass, aminophenyl or aminopropyl-derivatized glass, mercaptosilanized glass support, aldehyde or epoxide treatment. Amine (NH2), succinylation, disulfide and hydrazide (e.g., I-Linker™) may be used to modify oligonucleotide to facilitate the attachment of DNA to different surfaces.

A two-dimensional surface may be prepared by treating the glass surface with an amino silane which will result in a uniform layer of primary amine or epoxides. Parameters that affect the binding of oligonucleotides to the surface may be optimized to achieve the greatest specificity and DNA density. A high surface coverage of the oligonucleotide may generate a higher signaling due to higher hybridization between SPNs and their complementary sequences. The fluorescence background, chemical stability, complexity, amenability to chemical modification, surface area, loading capacity, and the degree of non-specific binding of detect molecule are adjusted for choosing appropriate surface support and conjugating chemistry.

For example, to increase the loading capacity of oligonucleotides on the planar surface structures of glasses, acrylamide gels can be applied to glasses to construct a—three-dimensional surface which will increase the surface area for DNA attachment.

4. In Situ Oligonucleotide Synthesis on Solid Support

In addition to attaching a synthesized aptamer, SPN or a SPN-complementary sequence to a solid support, nucleic acid molecules (e.g. aptamers, SPNs, and SPN complementary sequence) of the present invention can also be synthesized in situ on a solid support such as on magnetic particles, glass slides, wafers, microwell plates and silicon chips. Compared to the conventional method which requires the oligonucleotides to be pre-synthesized with specific end modifications to fit the surface attachment chemistry, this method can streamline the process of synthetic preparation by eliminating these steps.

The nucleic acid molecule can be synthesized by (a) covalently attaching one or more phosphoramidite linkers to the functional groups on the solid substrate to produce a derivatized support. (b) reacting the derivatized support with a nucleoside phosphoramidite corresponding to the first nucleotide of desired nucleotide sequence, and (c) adding nucleoside phosphoramidite stepwise until the entire oligonucleotide is assembled. Nucleoside phosphoramidites are preferred because naturally occurring nucleotides and their phosphodiester analogs are insufficiently reactive for an expeditious synthesis of oligonucleotides in high yields. Non-nucleoside phosphoramidites may be used to produce modified oligonucleotides.

External forces may be used to immobilize the solid substance during synthesis. For example, nucleic acid molecules may be synthesized on paramagnetic beads using the methods described in U.S. patent application Ser. No. 14/280,609 and Jensen et al., *J Biotechnol*, 2013, Sep. 20; 167(4); the contents of which are hereby incorporated by reference. The approach uses an external magnet to hold the paramagnetic beads in place during synthesis.

The nucleic acid synthesis can be performed in either the 5' to 3' direction or the 3' to 5' direction by suitable choice of nucleoside phosphoramidite reagents. For example, 3'-[(2-cyanoethyl)-(N,N-diisopropyl)]-phosphoramidites can be used for synthesis in the 3' to 5' direction. Alternatively, 5'-[(2-cyanoethyl)-(N,N-diisopropyl)]-phosphoramidites (Glen Research) can be used for synthesis in the 5' to 3' direction.

In certain embodiments, the substrate functional group used for attachment of the linker is a hydroxyl group or an amino group. For example, a hydroxylated substrate, such as hydroxylated polystyrene may be used for attachment of the linker. Phosphoramidite linkers are used to reduce steric hindrance associated with neighboring base-base interactions. In certain embodiments, the phosphoramidite linker is between 30 and 60 atoms in length. Exemplary phosphoramidite linkers include those disclosed in U.S. patent application Ser. No. 14/280,609; the contents of which are incorporated herein in its entirety.

5. Optimizing Oligonucleotide Synthesis on a Solid Support

In some embodiments, the short oligonucleotide sequences directly synthesized on a solid surface may be further optimized to fit the purpose of detection agents. In accordance with the present invention, a short sequence that is directly synthesized on a solid support (e.g., the surface of magnetic beads) will form a complex with the aptamer. The short oligonucleotide is complementary to one end of the aptamer sequence. The aptamer-complement complexes linked on the solid support are then used as detection agents. To fulfill this purpose, short complement sequences attached on a solid surface may meet the following features: (1) the oligonucleotides cannot be cleaved off from the surface following synthesis; (2) the oligonucleotides are being held away from the surface to allow hybridization with the complementary sequence on the aptamer to form aptamer-complement complexes; and (3) only low to moderate density of the complementary oligonucleotides are synthesized on the solid surface.

As described above, a standard 3' to 5' phosphoramidite chemical reaction may be used to for oligonucleotide synthesis. Automated synthesizers may be used to synthesize the short oligonucleotides using magnetic beads as supports. In one example, highly cross-linked polystyrene (PS) beads with proper particle sizes and good moisture exclusion properties may be used for efficient oligonucleotide synthesis. The polystyrene polymer may further bind together with magnetic particles (e.g., Fe3O4 particles) to form the solid support for direct oligonucleotide synthesis.

To stabilize synthesized oligonucleotide sequences on beads, non-cleavable stable linkers may be used for oligonucleotide synthesis. A non-cleavable linker is a chemical moiety immobilized on a solid support and not substantially cleaved under synthesis conditions (e.g., deprotection conditions). The linker may be covalently bound to a solid support (e.g., functionalized glass and magnetic beads).

Exemplary stable linkers may include, but are not limited to, amino linkers such as siloxane linkers, linkers containing alkyl groups such as —(OCH$_2$CH$_2$)$_n$— (n=1-20), —(CH$_2$)$_m$—C(O)NH—(CH$_2$)$_n$— and —(OCH$_2$CH$_2$)$_m$—C(O)NH—(OCH$_2$CH$_2$H$_2$)$_n$— (m and n can be the same or different and m and n are from about 1 to about 20), linkers containing amide groups like —R$_1$—C(O)NH—R$_2$—, monomethoxytrityl (MMT)-protected amino linker, monomethoxytrityl (MMT)-protected amino linker, trifluoroacetyl (TFA)-protected pentyl (C5) amino linker, and trifluoroacetyl (TFA)-protected hexyl (C6) amino linker. In some embodiments, the linker may be a complex linker comprising more than one functional group. Exemplary complex linkers may include those discussed in U.S. Pat. Nos. 7,553,958; 8,053,187; and 9,303,055; the contents of each of which are incorporated herein by reference in their entirety. Other non-cleavable linkers to solid supports may also include these disclosed in U.S. Pat. Nos. 8,569,515; and 8,853,132, the contents of each of which are incorporated herein by reference in their entirety.

In other embodiments, a spacer may be used to hold synthesized oligonucleotides away from the beads, therefore allow the short oligonucleotides to bind effectively to its complement on the end of the aptamer. As used herein, the term "spacer" refers to a chemical group connected to a linker that is used to extend the length of the linker moiety and as a site for initiating synthesis of a polymer chain. Examples of spacer include, but are not limited to, ethyleneglycol polymer, alkyl, oligonucleotides, peptides, and peptditomimetics. In other aspects, the spacer may be an anchor group that is attached to one end of the linker. The anchor group may be served as the site of oligonucleotide synthesis. At the end of oligonucleotide synthesis, a 5'DMT (4.4'-dimethoxytrityl) protecting group may be added to the last nucleoside, the role of which is to prevent interaction with the solid supports and between oligonucleotide polymers.

In some embodiments, low to moderate density of short oligonucleotides may be synthesized on the beads. The controlled loading allows for independent short oligonucleotides that have space to interact with the complementary sequence on the aptamer. The density of aptamer-complement complexes on the solid support may further be optimized to provide adequate signals when the conjugates are used in a detection assay.

In some embodiments, solid supports (e.g., magnetic beads and functionalized glasses) with synthesized oligonucleotides may be separated from the reaction suspension. For example, Magnet force may be used to pull down the beads from the reaction suspension. Separated beads are then read for fluorescent signals.

Target Allergens

Compositions, SPNs, SPN-complement complexes, magnetic particle conjugates and detection agents of the present invention may work as ligands for any target analyte. As stated below, the target analyte may be an allergen protein or variants thereof. In some embodiments, compositions, SPNs. SPN-complement complexes, magnetic particle conjugates and detection agents of the present invention may be designed to bind or associate with allergen proteins or other biomolecules which themselves associated with the allergen.

As used herein, the term "allergen" refers to a substance that can cause allergic reaction. An allergen is then a type of antigen that triggers an abnormally vigorous immune response in body.

Allergens include those from food products, the environment such as pollen, or animals such as a domestic pet dander. Food allergens include, but are not limited to proteins in legumes such as peanuts, peas, lentils and beans, tree nuts, wheat, milk, fish, egg white and sea food. Other allergens may be from the environment such as pollens, other animals (e.g., pet), pathogens and medicines. A comprehensive list of allergenic proteins from various sources is discussed below.

In some embodiments, allergens are food allergens. Examples of allergenic proteins associated with food include, but are not limited to, Brine shrimp (Art fr 5), Crab (Cha f 1), North Sea Shrimp (Cra c 1. Cra c 2, Cra c 4, Cra c 5, Cra c 6, Cra c 8), American lobster (Hom a 1, Hom a 3, Hom a 6), white shrimp (Lit v 1, Lit v 2, Lit v 3, Lit v4), giant freshwater prawn (Mac r 1), shrimp (Met e 1, Pen a 1, Pen i 1), northern shrimp (Pan b 1), spiny lobster (Pan s 1), black tiger shrimp (Pen m 1, Pen m 2, Pen m 3, Pen m 4, Pen m 6), narrow-clawed crayfish (Pon i 4, Pon i 7), blue swimmer crab (Por p 1), domestic cattle (Bos d 4, Bos d 5, Bos d 6, Bos d 7, Bos d 8, Bos d 9, Bos d 10, Bos d 11, Bos d 12), Atlantic herring (Clu h 1), common carp (Cyp c 1), Baltic cod (Gad c 1). Atlantic cod (Gad m 1, Gad m 2, Gad m 3), cod (Gad c 1), chicken (Gal d 1, Gal d 2, Gal d 3. Gal d 4, Gal d 5), Barramunda (Lat c 1), Lepidorhombus whiffiagonis (Lep w 1), chum salmon (One k 5), Atlantic salmon (Sal s 1, Sal s 2, Sal s 3) rainbow trout (One m 1), Mozambique tilapia (Ore m 4), edible frog (Ran e 1, Ran e 2), pacific pilchard (Sar sa 1), ocean perch (Seb m 1), yellowfin tuna (Thu a 1, Thu a 2, Thu a 3), swordfish (Xip g 1), abalone (Hal m 1), brown garden snail (Hel as 1), Squid (Tod p 1), pineapple (Ana c 1, Ana c 2), asparagus (Aspa o 1), barley (Hor v 12, Hor v 15, Hor v 16, Hor v 17, Hor v 20, Hor v 21), banana (Mus a 1, Mus a 2, Mus a 3, Mus a 4, Mus a 5), banana (Musxp1), rice (Ory s 12), rye (Sec c 20), wheat (Tri a 12, Tri a 14, Tri a 18, Tri a 19, Tri a 25, Tri a 26, Tri a 36, Tri a 37), maize (corn) (Zea m 14, Zea m 25), kiwi fruit (Act c1, Act c 2, Act c 5, Act c 8, Act c 10, Act d 1, Act d 2, Act d 3, Act d 4, Act d 5, Act d 6, Act d 7, Act d 8, Act d 9, Act d 10, Act d 1), cashew (Ana o 1, Ana o 2. Ana o 3), celery (Api g 1, Api g 2, Api g 3, Api g 4, Api g 5, Api g 6), peanut (Ara h 1, Ara h 2, Ara h 3, Ara h 4, Ara h 5, Ara h 6, Ara h 7, Ara h 8, Ara h 9, Ara h 10, Ara h 11, Ara h 12, Ara h 13), brazil nut (Ber e 1, Ber e 2), oriental mustard (Bra j 1), rapeseed (Bra n 1), cabbage (Bra o 3), turnip (Bra r 1, Bra r 2), bell pepper (Cap a 1w, Cap a 2), pecan (Car i 1, Car i 4), chestnut (Cas s 1, Cas s 5, Cas s 8, Cas s 9), lemon (Cit I 3), tangerine (Cit r 3), sweet orange (Cit s 1, Cit s 2, Cit s 3), Hazel (Cor a 1, Cor a 2, Cor a 8, Cor a 9, Cor a 11, Cor a 12, Cor a 13, Cor a 14), muskmelon (Cuc m 1, Cuc m 2, Cuc m 3), carrot (Dau c 1, Dau c 4, Dau c 5), common buckwheat (Fag e 2, Fag e 3), tartarian buckwheat (Fag t 2), strawberry (Fra a 1, Fra a 3, Fra a 4), soybean (Gly m 1, Gly m 2, Gly m 3, Gly m 4, Gly m 5, Gly m 6, Gly m 7, Gly m 8), sunflower (Hel a1, Hel a 2, Hel a 3), black walnut (Jug n 1, Jug n 2), English walnut (Jug r 1, Jug r 2, Jug r 3, Jug r 4), Cultivated lettuce (Lac s 1), Lentil (Len c 1, Len c 2, Len c 3), litchi (Lit c 1), narrow-leaved blue lupin (Lup an 1), apple (Mal d 1, Mal d 2, Mal d 3, Mal d 4), Cassava (Man e 5), mulberry (Mor n 3), avocado (Pers a 1), green bean (Pha v 3), pistachio (Pis v 1, Pis v 2, Pis v 3, Pis v 4, Pis v 5), pea (Pis s 1, Pis s 2), apricot (Pru ar 1, Pru ar 3), sweet cherry (Pru av 1, Pru av 2, Pru av 3, Pru av 4), European plum (Pru d 3), almond (Pru du 3, Pru du 4, Pru du 5, Pru du 6), peach (Pru p 1, Pru p 2, Pru p 3, Pru p 4, Pru p 7), pomegranate (Pun g 1), pear (Pyr c 1, Pyr c 3, Pyr c 4, Pyr c 5), castor bean (Ric c 1), red raspberry (Rub i 1, Rub i 3), Sesame (Ses i 1, Ses i 2, Ses i 3, Ses i 4, Ses i 5, Ses i 6, Ses i 7), yellow mustard (Sin a 1, Sin a 2, Sin a 3, Sin a 4), tomato (Sola I 1, Sola I 2, Sola I 3, Sola I 4), potato (Sola t 1, Sola t 2, Sola t 3, Sola t 4), Mung bean (Vig r 1, Vig r 2, Vig r 3, Vig r 4, Vig r 5, Vig r 6), grape (Vit v 1), Chinese date (Ziz m 1), *Anacardium occidentale* (Ana o 1.0101, Ana o 1.0102), *Apium graveolens* (Api g 1.0101, Api g 1.0201), *Daucus carota* (Dau c1.0101, Dau c1.0102, Dau c1.0103, Dau c1.0104, Dau c1.0105, Dau c1.0201), *Citrus sinensis* (Cit s3.0101, Cit s3.0102), *Glycine max* (Gly m1.0101, Gly m1.0102, Gly m3.0101, Gly m3.0102), *Lens*

*culinaris* (Len c1.0101, Len c1.0102, Len c1.0103), *Pisum sativum* (Pis s1.0101, Pis s1.0102), *Lycopersicon sativum* (Lye e2.0101, Lye e2.0102), *Fragaria ananassa* (Fra a3.0101, Fra a3.0102, Fra a3.0201, Fr a3.0202, Fra a3.0203, Fra a3.0204, Fra a3.0301), *Malus domestica* (Mal d1.0101, Mal d1.0102, Mal d1.0103, Mal d1.0104, Mal d1.0105, Mal d1.0106, Mal d1.0107, Mal d1.0108, Mal d1.0109, Mal d1.0201, Mal d1.0202, Mal d1.0203, Mal d1.0204, Mal d1.0205, Mal d1.0206, Mal d1.0207, Mal d1.0208, Mal d1.0301, Mal d1.0302, Mal d1.0303, Mal d1.0304, Mal d1.0401, Mal d1.0402, Mal d1.0403, Mal d3.0101w, Mal d3.0102w, Mal d3.0201w, Mal d3.0202w, Mal d3.0203w, Mal d4.0101, Mal d4.0102, Mal d4.0201, Mal d4.0202, Mal d4.0301, Mal d4.0302), *Prunus avium* (Pru av1.0101, Pru av1.0201, Pru av 1.0202, Pru av1.0203), and *Prunus persica* (Pru p4.0101, Pru p4.0201); and any variants thereof. The names of allergens associated with food are systematically named and listed according to IUIS Allergen Nomenclature Sub-Committee (see, International Union of Immunological Societies Allergen Nomenclature Sub-Committee, List of isoallergens and variants.)

In addition to food allergens, SPNs, magnetic particle conjugates and compositions of the present invention may detect airborne particulates/allergens and other environmental allergens. Samples that contain allergens may be obtained from plants (e.g. weeds, grasses, trees, pollens), animals (e.g., allergens found in the dander, urine, saliva, blood or other bodily fluid of mammals such as cat, dog, cow, pig, sheep, horse, rabbit, rat, guinea pig, mouse and gerbil), fungi/mold, insects (e.g., stinging insects such as bee, wasp, and hornet and chirnomidae (non-biting midges), as well as other insects such as the housefly, fruit fly, sheep blow fly, screw worm fly, grain weevil, silkworm, honeybee, non-biting midge larvae, bee moth larvae, mealworm, cockroach and larvae of *Tenibrio molitor* beetle; spiders and mites such as the house dust mite), rubbers (e.g. latex), metals, chemicals (e.g. drugs, protein detergent additives) and autoallergens and human autoallergens (e.g. Hom s 1, Hom s 2, Hom s 3, Hom s 4, Hom s 5) (see, Allergen Nomenclature: International Union of Immunological Societies Allergen Nomenclature Sub-Committee, List of allergens and Allergen Nomenclature: International Union of Immunological Societies Allergen Nomenclature Sub-Committee, List of isoallergens and variants).

Examples of allergenic proteins from plants that can be detected using the compositions of the present invention include, but are not limited to, ash (Fra e 1), Japanese cypress (Cha o1, Cha o 2), sugi (Cry j 1, Cry j 2), cypress (Cup a 1), common cypress (Cup s 1, Cup s 3), mountain cedar (Jun a 1, Jun a 2, Jun a 3, Jun s 1), prickly juniper (Jun o 4), eastern red cedar (Jun v 1, Jun v 3), sweet vernal grass (Ant o 1), saffron crocus (Cro s 1, Cro s 2), Bermuda grass (Cyn d 1, Cyn d 7, Cyn d 12, Cyn d 15, Cyn d 22w, Cyn d 23, Cyn d 24), orchard grass (Dac g 1, Dac g 2, Dac g 3, Dac g 4, Dac g 5), meadow fescue (Fes p 4), velvet grass (Hol l 1, Hol l 5), barley (Hor v 1, Hor v 5), rye grass (Lol p 1, Lol p 2, Lol p 3, Lol p 4, Lol p 11), bahia grass (Pas n 1), canary grass (Pha a 1, Pha a 5), timothy (Phl p 1, Phi p 2, Phi p 4, Phi p 5, Phi p 6, Phl p 7, Phl p 11, Phl p 12, Phi p 13), date palm (Pho d 2), Kentucky blue grass (Poa p 1, Poa p 5), rye (Sec c 1, Sec c 5, Sec c 38), Johnson grass (Sor h 1), wheat (Tri a 15, Tri a 21, Tri a 27, Tri a 28, Tri a29, Tri a30, Tri a 31, Tri a32, Tri a 33, Tri a 34, Tri a 35, Tri a 39), maize (Zea m 1, Zea m 12), alder (Aln g 1, Aln g 4), redroot pigweed (Ama r 2), short ragweed (Amb a 1, Amb a 2, Amb a 3, Amb a 4, Amb a 5, Amb a 6, Amb a 7, Amb a 8, Amb a 9, Amb a 10, Amb a 11), western ragweed (Amb p 5), giant ragweed (Amb t 5), mugwort (Art v 1, Art v 2, Art v 3, Art v 4, Art v 5, Art v 6), sugar beet (Beta v 1, beta v 2), European white birch (Bet v 1, Bet v 2, Bet v 3, Bet v 4, Bet v 6, Bet v 7), hornbeam (Car b 1), chestnut (Cas s 1), rosy periwinkle (Cat r 1), lamb's-quarters, pigweed (Che a 1, Che a 2, Che a 3), Arabian coffee (Cof a 1, Cof a 2, Cof a 3), Hazel (Cor a 6, Cor a 10), Hazel nut (Cor a1.04, Cor a2, Cor a8), European beech (Fag s 1), ash (Fra e 1), sunflower (Hel a 1, Hel a 2), para rubber tree (Hev b 1, Hev b 2, Hev b 3, Hev b 4, Hev b 5, Hev b 6, Hev b 7, Hev b 8, Hev b 9, Hev b 10, Hev b 11, Hev b 12, Hev b 13, Hev b 14). Japanese hop (Hum j 1), privet (Lig v 1), *Mercurialis annua* (Mer a 1), olive (Ole e 1, Ole e 2, Ole e 3, Ole e 4, Ole e 5, Ole e 6, Ole e 7, Ole e 8, Ole e 9, Ole e 10, Ole e 11), European hophornbeam (Ost c 1), *Parietaria judaica* (Par j 1, Par j 2, Par j 3, Par j 4), *Parietaria officinalis* (Par o 1), *Plantago lanceolata* (Pal l 1), London plane tree (Pla a 1, Pla a 2, Pla a 3), *Platanus orientalis* (Pla or 1, Pla or 2, Pla or 3), white oak (Que a 1), Russian thistle (Sal k 1, Sal k 2, Sal k 3, Sal k 4, Sal k 5), tomato (Sola I 5), Lilac (Syr v 1, Syr v 5), Russian-thistle (Sal k 1), English plantain (Pla 11), *Ambrosia artemisiifolia* (Amb a8.0101, Amb a8.0102, Amb a9.0101, Amb a9.0102), *Plantago lanceolata* (Pla 11.0101, Pla 11.0102, Pla 11.0103), *Parietaria judaica* (Par j 3.0102), *Cynodon dactylon* (Cyn d1.0101, Cyn d1.0102, Cyn d1.0103, Cyn d1.0104, Cyn d1.0105, Cyn d1.0106, Cyn d1.0107, Cyn d1.0201, Cyn d1.0202, Cyn d1.0203, Cyn d1.0204), *Holcus lanatus* (Hol 11.0101, Hol 11.0102), *Lolium perenne* (Phl p1.0101, Phl p1.0102, Phl p4.0101, Phl p4.0201, Phl p5.0101, Phl p5.0102, Phl p5.0103, Phi p5.0104, Phl p5.0105, Phl p5.0106, Phl p5.0107, Phl p5.0108, Phl p5.0201, Phl p5.0202), *Secale cereale* (Sec c20.0101. Sec c20.0201), *Betula Verrucosa* (Bet v1.0101, Bet v1.0102, Bet v 1.0103, Bet v 1.0201, Bet v 1.0301, Bet v1.0401, Bet v 1.0402, Bet v 1.0501, Bet v 1.0601, Bet v 1.0602, Bet v1.0701, Bet v1.0801, Bet v1.0901, Bet v1.1001, Bet v1.1101, Bet v1.1201, Bet v 1.1301, Bet v1.1401, Bet v1.1402, Bet v1.1501, Bet v1.1502, Bet v1.1601, Bet v1.1701, Bet v 1.1801, Bet v1.1901, Bet v1.2001, Bet v1.2101, Bet v1.2201, Bet v1.2301, Bet v1.2401, Bet v 1.2501, Bet v1.2601, Bet v1.2701, Bet v1.2801, Bet v1.2901, Bet v1.3001, Bet v1.3101, Bet v 6.0101, Bet v6.0102), *Carpinus betulus* (Car b1.0101, Car b1.0102, Car b1.0103, Car b1.0104, Car b1.0105, Car b1.0106, Car b1.0106, Car b1.0106, Car b1.0106, Car b1.0107, Car b1.0107, Car b1.0108, Car b1.0201, Car b1.0301, Car b1.0302), *Corylus avellana* (Cor a1.0101, Cor a1.0102, Cor a1.0103, Cor a1.0104, Cor a1.0201, Cor a1.0301. Cor a1.0401, Cor a1.0402, Cor a1.0403, Cor a1.0404), *Ligustrum vulgare* (Syr v1.0101, Syr v1.0102, Syr v1.0103), *Cryptomeria japonica* (Cry j2.0101, Cry j2.0102), and *Cupressus sempervirens* (Cup s1.0101, Cup s1.0102, Cup s1.0103, Cup s1.0104, Cup s1.0105), and any variants thereof.

Lupin is an herbaceous plant of the leguminous family belonging to the genus *Lupinus*. In Europe, lupin flour and seeds are widely used in bread, cookies, pastry, pasta, sauces, as well as in beverages as a substitute for milk or soy, and in gluten-free foods. The International Union of Immunological Societies (IUIS) allergen nomenclature subcommittee recently designated β-conglutin as the Lup an 1 allergen. (Nadal, et al., (2012) *PLoS one*, 7(4): e35253), and more recently, a high-affinity 11-mer DNA aptamer against Lup an 1 (β-conglutin) was reported (Nadal, et al., (2013), *Anal. Bioanal. Chem.* 405:9343-9349).

Examples of allergenic proteins from mites that can be detected using the compositions of the present invention include, but are not limited to, mite (Blo t 1, Blo t 3. Blo t 4, Blo t 5, Blo t 6, Blo t 10, Blo t 11, Blo t 12, Blo t 13, Blo t 19, Blot t 21); American house dust mite (Der f 1, Der f 2, Der f 3, Der f 7, Der f 10, Der f 11, Der f 13, Der f 14, Der f 15, Der f 16, Der f 17, Der f 18, Der f 22, Der f 24); *Dermatophagoides microceras* (house dust mite) (Der m 1); European house dust mite (Der p 1, Der p 2, Der p 3, Der p 4, Der p 5, Der p 6, Der p 7, Der p 8, Der p 9, Der p 10, Der p 11, Der p 14, Der p 15, Der p 20, Der p 21, Der p 23); *Euroglyphus maynei* (House dust mite) (Eur m 2, Eur m 2, Eur m 3, Eur m 4, Eur m 14); storage mite (Aca s 13, Gly d 2, Lep d 2, Lep d 5, Lep d 7, Lep d 10, Lep d 13, Tyr p 2, Tyr p 3, Tyr p 10, Tyr p 13. Tyr p 24), *Dermatophagoides farinae* (Der f1.0101, Der f1.0102, Der f1.0103, Der f1.0104, Der f1.0105, Der f2.0101, Der f2.0102, Der f2.0103, Der f2.0104, Der f2.0105, Der f2.0106, Der f2.0107, Der f2.0108, Der f2.0109, Der f2.0110, Der f2.0111, Der f2.0112, Der f2.0113, Der f2.0114, Der f2.0115, Der f2.0116, Der f2.0117), *Dermatophagoides pteronyssinus* (Der p 1.0101, Der p 1.0102, Der p 1.0103, Der p 1.0104, Der p1.0105, Der p1.0106, Der p1.0107, Der p1.0108, Der p1.0109, Der p1.0110, Der p1.0111. Der p1.0112, Der p1.0113, Der p1.0114, Der p1.0115, Der p1.0116, Der p1.0117, Der p1.0118, Der p1.0119, Der p1.0120, Der p1.0121, Der p1.0122, Der p1.0123, Der p2.0101, Der p2.0102, Der p2.0103, Der p2.0104, Der p2.0105, Der p2.0106, Der p2.0107, Der p2.0108, Der p2.0109, Der p2.0110, Der p2.0111, Der p2.0112, Der p2.0113), *Euroglyphus maynei* (Eur m2.0101, Eur m2.0102), *Lepidoglyphus destructor* (Lep d2.0101, Lep d2.0101, Lep d2.0101, Lep d2.0102, Lep d2.0201, Lep d2.020) and *Glycphagus domesticus* (Gly d2.0101, Gly d2.0201); and any variants thereof.

Examples of allergenic proteins from animals that can be detected using the compositions of the present invention include, but are not limited to, domestic cattle (Bos d 2, Bos d 3, Bos d 4, Bos d 5, Bos d 6, Bos d 7, Bos d 8), dog (Can f 1, Can f 2, Can f3, Can f 4, Can f 5, Can f 6), domestic horse (Equ c 1, Equ c 2, Equ c 3, Equ c 4, Equ c 5), cat (Fel d 1, Fel d 2, Fel d 3, Fel d 4, Fel d 5w, Fel d 6w, Fel d 7, Fel d 8), mouse (Mus m 1), guinea pig (Cav p 1, Cav p 2, Cav p 3, Cav p 4, Cav p 6), rabbit (Ory c 1, Ory c 3, Ory c 4) rat (Rat n 1), *Bos domesticus* (Bos d 2.0101, Bos d 2.0102, Bos d 2.0103) and *Equus caballus* (Equ c2.0101, Equ c 2.0102); and any variants thereof Examples of allergenic proteins from insects that can be detected using the compositions of the present invention include, but are not limited to, yellow fever mosquito (Aed a 1, Aed a 2, Aed a 3). Eastern hive bee (Api c 1), giant honeybee (Api d 1), honey bee (Api m 1, Api m 2, Api m 3, Api m 4, Api m 5, Api m 6, Api m 7, Api m 8, Api m 9, Api m 10, Api m 11, Api m 12), pigeon tick (Arg r 1), German cockroach (Bla g 1, Bla g 2, Bla g 3, Bla g 4, Bla g 5, Bla g 6, Bla g 7, Bla g 8, Bla g 11), bumble bee (Bom p 1, Bom p 4, Bom t 1, Bom t 4), silk moth (Bomb m 1), midge (Chi k 10, Chi t 1, Chi t 1.01, Chi t 2, Chit 2. 0101, Chi t 2. 0102, Chit 3, Chit 4, Chit 5, Chit 6, Chi t 6.01, Chit 7, Chi t 8, Chit 9), cat flea (Cte f 1, Cte f 2, Cte f 3), yellow hornet (Dol a 5), white face hornet (Dol m 1, Dol m 2, Dol m 5), biting midge (For t 1, For t 2), Savannah Tsetse fly (Glo m 5), Asian ladybeetle (Har a 1, Har a 2), silverfish (Lep s 1), booklouse (Lip b 1), Australian jumper ant (Myr p 1, Myr p 2, Myr p 3), American cockroach (Per a 1, Per a 3, Per a 6, Per a 7, Per a 9, Per a 10), Indian meal moth (Plo i 1, Plo i 2), wasp (Pol a 1, Pol a 2, Pol a 5, Pole 1, Pol e 4, Pol e 5, Pol f 5, Pol g 1, Pol g 5, Pol m 5, Poly p 1, Poly s 5, Ves vi 5), Mediterranean paper wasp (Pol d 1, Pol d 4, Pol d 5), tropical fire ant (Sol g 2, Sol g 3, Sol g 4), *Solenopsis invicta* (red imported fire ant) (Sol I 1, Sol I 2, Sol I 3, Sol I 4), black fire ant (Sol r 2, Sol r 3), Brazilian fire ant (Sol s 2, Sol s 3), horsefly (Tab y 1, Tab y 2, Tab y 5), pine processionary moth (Tha p 1, Tha p 2), California kissing bug (Tria p 1), European hornet (Vesp c 1, Vesp c 5), *Vespa magnifica* (hornet) (Vesp ma 2, Vesp ma 5), *Vespa mandarinia* (Giant asian hornet) (Vesp m1, Vesp m 5), yellow jacket (Ves f 5, Ves g 5, Ves m 1, Ves m 2, Ves m 5), *Vespula germanica* (yellow jacket) (Ves p 5), *Vespula squamosa* (Yellow jacket) (Ves s 1, Ve s s5), *Vespula vulgaris* (Yellow jacket) (Ves v 1, Ves v 2, Ves v 3, Ves v 4, Ves v 5, Ves v 6), *Blattella germanica* (Bla g 1.0101, Bla g 1.0102, Bla g 1.0103, Bla g 1.02, Bla g 6.0101, Bla g 6.0201, Bla g 6.0301), *Periplaneta Americana* (Per a1.0101, Per a1.0102, Per a1.0103, Per a1.0104, Per a1.02, Per a3.01, Per a3.0201, Per a3.0202, Per a3.0203, Per a7.0101, Per a7.0102), *Vespa crabo* (Ves pc 5.0101, Ves pc 5.0101), *Vespa mandarina* (Vesp m 1.01, Vesp m 1.02); and any variants thereof.

Examples of allergenic proteins from fungi/mold that can be detected using the signaling polynucleotides and assays of the present invention include, but are not limited to, *Alternaria alternata* (Alternaria rot fungus) (Alt a 1, Alt a 3, Alt a 4, Alt a 5, Alt a 6, Alt a 7, Alt a 8, Alt a 10, Alt a 12, Alt a 13), *Aspergillus flavus* (fungus) (Asp fl 13), *Aspergillus fumigatus* (fungus) (Asp f 1, Asp f 2, Asp f 3, Asp f 4, Asp f 5, Asp f 6, Asp f 7, Asp f 8, Asp f9, Asp f 10, Asp f 11, Asp f 12, Asp f 13, Asp f 15, Asp f 16, Asp f 17, Asp f 18, Asp f22, Asp f 23, Asp f 27, Asp f 28, Asp f 29, Asp f 34), *Aspergillus niger* (Asp n 14, Asp n 18, Asp n 25), *Aspergillus oryzae* (Asp o 13, Asp o 21), *Aspergillus versicolor* (Asp v 13), *Candida albicans* (Yeast) (Cand a 1, Cand a 3), *Candida boidinii* (Yeast) (Cand b 2), *Cladosporium cladosporioides* (Cla c 9, Cla c 14), *Cladosporium herbarum* (Cla h 2, Cla h 5, Cla h 6, Cla h 7, Cla h 8, Cla h 9, Cla h 10, Cla h 12), *Curvularia lunata* (Synonym: *Cochliobolus lunatus*) (Cur l 1, Cur l 2, Cur l 3, Cur l 4), *Epicoccum purpurascens* (Soil fungus) (Epi p 1), *Fusarium culmorum* (N.A.) (Fus c 1, Fus c 2). *Fusarium proliferatum* (Fus p 4), *Penicillium brevicompactum* (Pen b 13, Pen b 26), *Penicillium chrysogenum* (Pen ch 13, Pen ch 18, Pen ch 20, Pen ch 31, Pen ch 33, Pen ch 35), *Penicillium citrinum* (Pen c 3. Pen c 13, Pen c 19, Pen c 22, Pen c 24, Pen c 30. Pen c 32), *Penicillium crustosum* (Pen cr 26), *Penicillium oxalicum* (Pen o 18), *Stachybotrys chartarum* (Sta c 3), *Trichophyton rubrum* (Tri r 2, Tri r 4), *Trichophyton tonsurans* (Tri t 1, Tri t 4), *Psilocybe cubensis* (Psi c 1, Psi c 2), Shaggy cap (Cop c 1, Cop c 2, Cop c 3, Cop c 5, Cop c 7), *Rhodotorula mucilaginosa* (Rho m 1, Rho m 2), *Malassezia furfur* (Malaf2, Malaf3, Malaf4), *Malassezia sympodialis* (Malas1, Malas5, Malas6, Malas7, Malas8, Malas9, Malas10, Malas11, Malas12, Malas13) and *Alternaria alternate* (Alt a1.0101, Alt a1.0102); and any variants thereof.

Examples of additional allergens include, but are not limited to, Nematode (Ani s 1, Ani s 2, Ani s 3, Ani s 4), worm (Asc s 1), soft coral (Den n 1), rubber (Latex) (Hev b 1, Hev b 2, Hev b 3, Hev b 5, Hev b 6, Hev b 7, Hev b 8, Hev b 9, Hev b 10, Hev b 11, Hev b 12, Hev b 13), obeche (Trip s 1) and Heveabrasiliensis (Hev b6.01, Hev b6.0201, Hev b6.0202, Hev b6.03, Hev b8.0101, Hev b8.0102, Hev b8.0201, Hev b8.0202, Hev b8.0203, Hev b8.0204, Hev b10.0101, Hev b10.0102, Hev b10.0103, Hev b11.0101, Hev b11.0102); and any variants thereof.

Table 5 provides a list of non-limiting examples of allergenic proteins from various species. In the table, in addition to the species and allergen name, provided are the biochemical name of the allergenic protein and the unique identification numbers from GenBank or UniProt databases. In some embodiments, SPNs, magnetic particle conjugates and compositions of the present invention may be used to detect any of the allergenic proteins listed in Table 5, or any variant, fragment or antigenic portion thereof.

TABLE 5

Allergen proteins

| Species | Allergen | Food Allergen | Biochemical name | GenBank | Uniprot | SEQ ID NO |
|---|---|---|---|---|---|---|
| | | | Animalia Arthropoda | | | |
| *Acarus siro* (Storage mite) | *Aca s* 13 | No | Fatty acid-binding protein | ABL09307.1 | B0KZJ6 | 805 |
| *Aedes aegypti* (Yellow fever mosquito) | *Aed a* 1 | No | Apyrase | AAC37218 | P50635 | 806 |
| *Aedes aegypti* (Yellow fever mosquito) | *Aed a* 2 | No | Salivary D7 protein | AAA29347 | P18153 | 807 |
| *Aedes aegypti* (Yellow fever mosquito) | *Aed a* 3 | No | Undefined 30 kDa salivary protein | AAB58417 | O01949 | 808 |
| *Aedes aegypti* (Yellow fever mosquito) | *Aed a* 4 | No | α-glucosidase | P13080 | / | 809 |
| *Aedes aegypti* (Yellow fever mosquito) | *Aed a* 5 | No | Sarcoplasmic Ca$^+$ (EF-hand) binding protein | XP_001653462.1 | Q16XK7 | 810 |
| *Aedes aegypti* (Yellow fever mosquito) | *Aed a* 6 | No | Porin3 | XP_001654143.1 | Q1HR57 | 811 |
| *Aedes aegypti* (Yellow fever mosquito) | *Aed a* 7 | No | Undefined protein | XP_001654291.1 | Q16TN9 | 812 |
| *Aedes aegypti* (Yellow fever mosquito) | *Aed a* 8 | No | Heat Shock cognate protein-70 | ABF18258.1 | Q1HR69 | 813 |
| *Aedes aegypti* (Yellow fever mosquito) | *Aed a* 10.0101 | No | Tropomyosin | XP_001655954.1 | Q17H75 | 814 |
| *Aedes aegypti* (Yellow fever mosquito) | *Aed a* 10.0102 | No | Tropomyosin | XP_001655948.1 | Q17H80 | 815 |
| *Aedes aegypti* (Yellow fever mosquito) | *Aed a* 11 | No | Lysosomal aspartic protease | XP_001657556.1 | Q03168 | 816 |
| *Apis cerana* (Asiatic honey bee) | *Api c* 1 | No | Phospholipase A2 | AAK09361 | Q9BMK4 | 817 |
| *Apis dorsata* (Giant honeybee) | *Api d* 1 | No | Phospholipase A2 | Q7M4I5 | Q7M4I5 | 818 |
| *Apis mellifera* (Honey bee) | *Api m* 1 | No | Phospholipase A2 | CAA34681 | P00630 | 819 |
| *Apis mellifera* (Honey bee) | *Api m* 2 | No | Hyaluronidase | AAA27730 | Q08169 | 820 |
| *Apis mellifera* (Honey bee) | *Api m* 3 | No | Acid phosphatase | AAY57281 | Q4TUB9 | 821 |
| *Apis mellifera* (Honey bee) | *Api m* 4 | No | Melittin | CAA26038 | P01501 | 822 |
| *Apis mellifera* (Honey bee) | *Api m* 5 | No | Dipeptidylpeptidase IV | NP_001119715 | B2D0J4 | 823 |
| *Apis mellifera* (Honey bee) | *Api m* 6 | No | / | NP_001035360 | Q27SJ8 | 824 |
| *Apis mellifera* (Honey bee) | *Api m* 7 | No | CUB serine protease | AAN02286 | Q8MQS8 | 825 |
| *Apis mellifera* (Honey bee) | *Api m* 8 | No | Carboxylesterase VI | ACB70231 | B2D0J5 | 826 |
| *Apis mellifera* (Honey bee) | *Api m* 9 | No | Serine carboxypeptidase | ACN71203 | C9WMM5 | 827 |
| *Apis mellifera* (Honey bee) | *Api m* 10 | No | Icarapin variant 2, carbohydrate-rich protein | ABF21078 | Q1HHN7 | 828 |
| *Apis mellifera* (Honey bee) | *Api m* 11.0101 | No | Major royal jelly protein 8, variant 1 | NP_001011564 | B3GM11 | 829 |
| *Apis mellifera* (Honey bee) | *Api m* 11.0201 | No | Major royal jelly protein 8, variant 2 | AAY21180 | Q4ZJX1 | 830 |
| *Apis mellifera* (Honey bee) | *Api m* 12 | No | Vitellogenin | CAD56944 | Q868N5 | 831 |
| *Archaeopotamobius sibiriensis* (Crustacean species decapod) | *Arc s* 8 | Yes | Triosephosphate isomerase | CAD29196 | Q8T5G9 | 832 |
| *Argas reflexus* (Pigeon tick) | *Arg r* 1 | No | / | CAG26895 | Q5GQ85 | 833 |
| *Artemia franciscana* (Brine shrimp) | *Art fr* 5 | Yes | Myosin, light chain 1 | ABS19977 | A7L499 | 834 |
| *Blattella germanica* (German cockroach) | *Bla g* 1.0101 | No | / | AAD13530 | Q9UAM5 | 835 |
| *Blattella germanica* (German cockroach) | *Bla g* 1.0201 | No | / | AAD13531 | O96522 | 836 |
| *Blattella germanica* (German cockroach) | *Bla g* 2 | No | Aspartic protease | AAA86744 | P54958 | 837 |
| *Blattella germanica* (German cockroach) | *Bla g* 3 | No | Hemocyanin | ACY40651 | D0VNY7 | 838 |
| *Blattella germanica* (German cockroach) | *Bla g* 4 | No | Calycin | AAA87851 | P54962 | 839 |
| *Blattella germanica* (German cockroach) | *Bla g* 5 | No | Glutathione S-transferase | AAB72147 | O18598 | 840 |

TABLE 5-continued

Allergen proteins

| Species | Allergen | Food Allergen | Biochemical name | GenBank | Uniprot | SEQ ID NO |
|---|---|---|---|---|---|---|
| *Blattella germanica* (German cockroach) | *Bla g* 6.0101 | No | Troponin C, isoform 1 | ABB89296 | Q1A7B3 | 841 |
| *Blattella germanica* (German cockroach) | *Bla g* 6.0201 | No | Troponin C, isoform 2 | ABB89297 | Q1A7B2 | 842 |
| *Blattella germanica* (German cockroach) | *Bla g* 6.0301 | No | Troponin C, isoform 3 | ABB89298 | Q1A7B1 | 843 |
| *Blattella germanica* (German cockroach) | *Bla g* 7 | No | Tropomyosin | AAF72534 | Q9NG56 | 844 |
| *Blattella germanica* (German cockroach) | *Bla g* 8 | No | Myosin, light chain | ABD47458 | A0ERA8 | 845 |
| *Blattella germanica* (German cockroach) | *Bla g* 9 | No | Arginine kinase | ABC86902 | / | 846 |
| *Blattella germanica* (German cockroach) | *Bla g* 11 | No | Alpha-amylase | ABC68516 | Q2L7A6 | 847 |
| *Blomia tropicalis* (Storage mite) | *Blo t* 1.0101 | No | Cysteine protease, isoform 1 | AK58415 | Q95PJ4 | 848 |
| *Blomia tropicalis* (Storage mite) | *Blo t* 1.0201 | No | Cysteine protease, isoform 2 | AAQ24541 | A1KXI0 | 849 |
| *Blomia tropicalis* (Storage mite) | *Blo t* 2.0101 | No | / | AAQ73483 | Q1M2P1 | 850 |
| *Blomia tropicalis* (Storage mite) | *Blo t* 2.0102 | No | / | AAQ73482 | Q1M2P2 | 851 |
| *Blomia tropicalis* (Storage mite) | *Blo t* 2.0103 | No | / | AAQ73481 | Q1M2P3 | 852 |
| *Blomia tropicalis* (Storage mite) | *Blo t* 3 | No | Trypsin | AAM10779 | Q8I916 | 853 |
| *Blomia tropicalis* (Storage mite) | *Blo t* 4 | No | Alpha amylase | AAQ24543 | A1KXI2 | 854 |
| *Blomia tropicalis* (Storage mite) | *Blo t* 5 | No | / | AAD10850 | O96870 | 855 |
| *Blomia tropicalis* (Storage mite) | *Blo t* 6 | No | Chymotrypsin | AAQ24544 | A1KXI3 | 856 |
| *Blomia tropicalis* (Storage mite) | *Blo t* 7 | No | Bactericidal permeability-increasing like protein | ASX95438 | / | 857 |
| *Blomia tropicalis* (Storage mite) | *Blo t* 8 | No | Glutathione S-transferase | ACV04860 | C8CGT7 | 858 |
| *Blomia tropicalis* (Storage mite) | *Blo t* 10 | No | Tropomyosin | ABU97466 | A7XZI4 | 859 |
| *Blomia tropicalis* (Storage mite) | *Blo t* 11 | No | Paramyosin | AAM83103 | Q8MUF6 | 860 |
| *Blomia tropicalis* (Storage mite) | *Blo t* 12 | No | / | AAA78904 | Q17282 | 861 |
| *Blomia tropicalis* (Storage mite) | *Blo t* 13 | No | Fatty acid-binding protein | AAC80579 | Q17284 | 862 |
| *Blomia tropicalis* (Storage mite) | *Blo t* 19 | No | Anti-microbial peptide homologue | AHG97583 | W5RZ24 | 863 |
| *Blomia tropicalis* (Storage mite) | *Blo t* 21 | No | / | AAX34047 | A7IZE9 | 864 |
| *Bombus pennsylvanicus* (Bumble bee) | *Bom p* 1 | No | Phospholipase A2 | Q7M4I6 | Q7M4I6 | 865 |
| *Bombus pennsylvanicus* (Bumble bee) | *Bom p* 4 | No | Protease | Q7M4I3 | Q7M4I3 | 866 |
| *Bombus terrestris* (Bumble bee) | *Bom t* 1 | No | Phospholipase A2 | P82971 | P82971 | 867 |
| *Bombus terrestris* (Bumble bee) | *Bom t* 4 | No | Protease | P0CH88 | P0CH88 | 868 |
| *Bombyx mori* (Silk moth) | *Bomb m* 1 | Yes | Arginine kinase | ABB88514 | Q2F5T5 | 869 |
| *Charybdis feriatus* (Crab) | *Cha f* 1 | Yes | Tropomyosin | AAF35431 | Q9N2R3 | 870 |
| *Chironomus kiiensis* (Midge) | *Chi k* 10 | No | Tropomyosin | CAA09938 | O96764 | 871 |
| *Chironomus thummi thummi* (Midge) | *Chi t* 1.0101 | No | Hemoglobin, component III | AAA28249 | P02229 | 872 |
| *Chironomus thummi thummi* (Midge) | *Chi t* 1.0201 | No | Hemoglobin, component IV | AA25438 | P02230 | 873 |
| *Chironomus thummi thummi* (Midge) | *Chi t* 2.0101 | No | Hemoglobin, component I/IA | AAA80189 | P02221 | 874 |
| *Chironomus thummi thummi* (Midge) | *Chi t* 2.0201 | No | Hemoglobin, component I/IA | / | P02221 (variant A113T) | 874 |
| *Chironomus thummi thummi* (Midge) | *Chi t* 3.0101 | No | Hemoglobin, components II-beta | AAB58932 | P02222 | 875 |

TABLE 5-continued

Allergen proteins

| Species | Allergen | Food Allergen | Biochemical name | GenBank | Uniprot | SEQ ID NO |
|---|---|---|---|---|---|---|
| *Chironomus thummi thummi* (Midge) | *Chi t* 3.0201 | No | Hemoglobin, components VI | AAA69813 | P02224 | 876 |
| *Chironomus thummi thummi* (Midge) | *Chi t* 3.0301 | No | Hemoglobin, components VIIA | AAB58930 | P02226 | 877 |
| *Chironomus thummi thummi* (Midge) | *Chi t* 3.0401 | No | Hemoglobin, components IX | AAB58931 | P02223 | 878 |
| *Chironomus thummi thummi* (Midge) | *Chi t* 3.0501 | No | Hemoglobin, components VIIB-3 | AAA28260 | P12548 | 879 |
| *Chironomus thummi thummi* (Midge) | *Chi t* 3.0601 | No | Hemoglobin, components VIIB-4 | AAA85491 | P84296 | 880 |
| *Chironomus thummi thummi* (Midge) | *Chi t* 3.0701 | No | Hemoglobin, components VIIB-9 | AAA69815 | P84298 | 881 |
| *Chironomus thummi thummi* (Midge) | *Chi t* 3.0702 | No | Hemoglobin, components VIIB-6 | AAA85486 | P12549 | 882 |
| *Chironomus thummi thummi* (Midge) | *Chi t* 3.0801 | No | Hemoglobin, components VIIB-7 | AAA85485 | P12550 | 883 |
| *Chironomus thummi thummi* (Midge) | *Chi t* 3.0901 | No | Hemoglobin, components VIII | P02227 | P02227 | 884 |
| *Chironomus thummi thummi* (Midge) | *Chi t* 4 | No | Hemoglobin, component IIIA | P02231 | P02231 | 885 |
| *Chironomus thummi thummi* (Midge) | *Chi t* 9 | No | Hemoglobin, component X | P02228 | P02228 | 886 |
| *Chortoglyphus arcuatus* (Storage mite) | *Cho a* 10 | No | Tropomyosin | AEX31649 | / | 887 |
| *Crangon crangon* (North Sea shrimp) | *Cra c* 1 | Yes | Tropomyosin | ACR43473 | D7F1J4 | 888 |
| *Crangon crangon* (North Sea shrimp) | *Cra c* 2 | Yes | Arginine kinase | ACR43474 | D7F1J5 | 889 |
| *Crangon crangon* (North Sea shrimp) | *Cra c* 4 | Yes | Sarcoplasmic calcium-binding protein | ACR43475 | D7F1P9 | 890 |
| *Crangon crangon* (North Sea shrimp) | *Cra c* 5 | Yes | Myosin, light chain 1 | ACR43477 | D7F1Q1 | 891 |
| *Crangon crangon* (North Sea shrimp) | *Cra c* 6 | Yes | Troponin C | ACR43478 | D7F1Q2 | 892 |
| *Crangon crangon* (North Sea shrimp) | *Cra c* 8 | Yes | Triosephosphate isomerase | ACR43476 | D7F1Q0 | 893 |
| *Ctenocephalides felis* (Cat flea) | *Cte f* 1 | No | Salivary antigen 1 | AAC69105 | Q94424 | 894 |
| *Ctenocephalides felis* (Cat flea) | *Cte f* 2 | No | Salivary allergen 2 | AAF65314 | Q9NH66 | 895 |
| *Ctenocephalides felis* (Cat flea) | *Cte f* 3 | No | Salivary allergen 3 | / | / | / |
| *Dermatophagoides farinae* (American house dust mite) | *Der f* 1.0101 | No | Cysteine protease (preproenzyme) | BAC53948 | Q58A71 | 896 |
| *Dermatophagoides farinae* (American house dust mite) | *Der f* 1.0102 | No | Cysteine protease variant | / | Q3HWZ4 (variant) | 897 |
| *Dermatophagoides farinae* (American house dust mite) | *Der f* 1.0106 | No | Cysteine protease-1 | BAC53948 | P16311 | 898 |
| *Dermatophagoides farinae* (American house dust mite) | *Der f* 1.0108 | No | Cysteine protease | ABL84749 | A1YW11 | 899 |
| *Dermatophagoides farinae* (American house dust mite) | *Der f* 1.0109 | No | Cysteine protease | ABL84750 | A1YW12 | 900 |
| *Dermatophagoides farinae* (American house dust mite) | *Der f* 1.0110 | No | Vitellogenin | ABL84751 | A1YW13 | 901 |
| *Dermatophagoides farinae* (American house dust mite) | *Der f* 2.0101 | No | NPC2 family | BAA01239 | Q00855 (variant) | 902 |
| *Dermatophagoides farinae* (American house dust mite) | *Der f* 2.0102 | No | NPC2 family | BAA01240 | Q00855 | 903 |
| *Dermatophagoides farinae* (American house dust mite) | *Der f* 2.0103 | No | NPC2 family | BAA01241 | Q00855 (variant) | 903 |
| *Dermatophagoides farinae* (American house dust mite) | *Der f* 2.0105 | No | NPC2 family | AAL47677 | Q8WQK5 | 904 |
| *Dermatophagoides farinae* (American house dust mite) | *Der f* 2.0106 | No | NPC2 family | CAI05848 | Q5TIW2 | 905 |

TABLE 5-continued

Allergen proteins

| Species | Allergen | Food Allergen | Biochemical name | GenBank | Uniprot | SEQ ID NO |
|---|---|---|---|---|---|---|
| *Dermatophagoides farinae* (American house dust mite) | *Der f* 2.0107 | No | NPC2 family | CAI05849 | Q5TIW1 | 906 |
| *Dermatophagoides farinae* (American house dust mite) | *Der f* 2.0108 | No | NPC2 family | CAI05850 | Q5TIW0 | 907 |
| *Dermatophagoides farinae* (American house dust mite) | *Der f* 2.0109 | No | NPC2 family | ABA39438 | Q3HWZ2 | 908 |
| *Dermatophagoides farinae* (American house dust mite) | *Der f* 2.0112 | No | NPC2 family | AAP35073 | A1KXH0 | 909 |
| *Dermatophagoides farinae* (American house dust mite) | *Der f* 2.0116 | No | NPC2 family | / | A3F5F1 | 910 |
| *Dermatophagoides farinae* (American house dust mite) | *Der f* 3 | No | Trypsin | BAA09920 | P49275 | 911 |
| *Dermatophagoides farinae* (American house dust mite) | *Der f* 4 | No | alpha-amylase | AHX03180 | / | 912 |
| *Dermatophagoides farinae* (American house dust mite) | *Der f* 6 | No | Chymotrypsin | AAF28423 | P49276 | 913 |
| *Dermatophagoides farinae* (American house dust mite) | *Der f* 7 | No | Bactericidal permeability-increasing like protein | AAB35977 | Q26456 | 914 |
| *Dermatophagoides farinae* (American house dust mite) | *Der f* 8 | No | Glutathione S-transferase | AGC56215 | / | 915 |
| *Dermatophagoides farinae* (American house dust mite) | *Der f* 10 | No | Tropomyosin | BAA04557 | Q23939 | 916 |
| *Dermatophagoides farinae* (American house dust mite) | *Der f* 11 | No | Paramyosin | AAK39511 | Q967Z0 | 917 |
| *Dermatophagoides farinae* (American house dust mite) | *Der f* 13 | No | Fatty acid binding protein | AAP35078 | Q1M2P5 | 918 |
| *Dermatophagoides farinae* (American house dust mite) | *Der f* 14 | No | Apolipophorin | BAA04558 | Q94507 | 919 |
| *Dermatophagoides farinae* (American house dust mite) | *Der f* 15 | No | Chitinase | AAD52672 | Q9U6R7 | 920 |
| *Dermatophagoides farinae* (American house dust mite) | *Der f* 16 | No | Gelsolin/villin | AAM64112 | Q8MVU3 | 921 |
| *Dermatophagoides farinae* (American house dust mite) | *Der f* 17 | No | Calcium binding protein | / | / | / |
| *Dermatophagoides farinae* (American house dust mite) | *Der f* 18 | No | Chitin-binding protein | AAM19082 | Q86R84 | 922 |
| *Dermatophagoides farinae* (American house dust mite) | *Der f* 20.0101 | No | / | AIO08850.1 | / | 923 |
| *Dermatophagoides farinae* (American house dust mite) | *Der f* 20.0201 | No | Arginine kinase | ABU97470.1 | A7XZJ2 | 924 |
| *Dermatophagoides farinae* (American house dust mite) | *Der f* 21 | No | / | AHC94806 | B2GM84 | 925 |
| *Dermatophagoides farinae* (American house dust mite) | *Der f* 22 | No | / | ABG35122 | A5X5X4 | 926 |
| *Dermatophagoides farinae* (American house dust mite) | *Der f* 24 | No | Ubiquinol-cytochrome c reductase binding protein homologue | AGI78542 | M9RZ95 | 927 |
| *Dermatophagoides farinae* (American house dust mite) | *Der f* 25.0101 | No | Triosephosphate isomerase | AGC56216 | L7UZA7 | 928 |
| *Dermatophagoides farinae* (American house dust mite) | *Der f* 25.0201 | No | Triosephosphate isomerase | AIO08860.1 | / | 929 |

TABLE 5-continued

Allergen proteins

| Species | Allergen | Food Allergen | Biochemical name | GenBank | Uniprot | SEQ ID NO |
|---|---|---|---|---|---|---|
| *Dermatophagoides farinae* (American house dust mite) | *Der f* 26 | No | Myosin alkali light chain | AIO08852.1 | / | 930 |
| *Dermatophagoides farinae* (American house dust mite) | *Der f* 27 | No | Serpin | AIO08851.1 | / | 931 |
| *Dermatophagoides farinae* (American house dust mite) | *Der f* 28.0101 | No | Heat Shock Protein | AGC56218.1 | L7V065 | 932 |
| *Dermatophagoides farinae* (American house dust mite) | *Der f* 28.0201 | No | Heat Shock Protein | AIO08848.1 | / | 933 |
| *Dermatophagoides farinae* (American house dust mite) | *Der f* 29 | No | Peptidyl-prolyl cis-trans isomerase (cyclophilin) | AAP35065 | A1KXG2 | 934 |
| *Dermatophagoides farinae* (American house dust mite) | *Der f* 30 | No | Ferritin | AGC56219.1 | L7UZ91 | 935 |
| *Dermatophagoides farinae* (American house dust mite) | *Der f* 31 | No | Cofilin | AIO08870.1 | / | 936 |
| *Dermatophagoides farinae* (American house dust mite) | *Der f* 32 | No | Secreted inorganic pyrophosphatase | AIO08849.1 | / | 937 |
| *Dermatophagoides farinae* (American house dust mite) | *Der f* 33 | No | alpha-tubulin | AIO08861 | / | 938 |
| *Dermatophagoides farinae* (American house dust mite) | *Der f* 34 | No | enamine/imine deaminase | / | / | / |
| *Dermatophagoides farinae* (American house dust mite) | *Der f* 35 | No | / | / | / | / |
| *Dermatophagoides microceras* (House dust mite) | *Der m* 1 | No | Cysteine protease | P16312 | P16312 | 939 |
| *Dermatophagoides pteronyssinus* (European house dust mite) | *Der p* 1.0101 | No | Cysteine protease | AAB60215 (variant) | P08176 (variant) | 940 |
| *Dermatophagoides pteronyssinus* (European house dust mite) | *Der p* 1.0102 | No | Cysteine protease | AAB60215 | P08176 | 941 |
| *Dermatophagoides pteronyssinus* (European house dust mite) | *Der p* 1.0103 | No | Cysteine protease | AAB60215 (variant) | P08176 (variant) | 940 |
| *Dermatophagoides pteronyssinus* (European house dust mite) | *Der p* 1.0104 | No | Cysteine protease | / | P08176 (variant) | 941 |
| *Dermatophagoides pteronyssinus* (European house dust mite) | *Der p* 1.0105 | No | Cysteine protease | / | P08176 (variant) | 941 |
| *Dermatophagoides pteronyssinus* (European house dust mite) | *Der p* 1.0106 | No | Cysteine protease | / | P08176 (variant) | 941 |
| *Dermatophagoides pteronyssinus* (European house dust mite) | *Der p* 1.0107 | No | Cysteine protease | / | P08176 (variant) | 941 |
| *Dermatophagoides pteronyssinus* (European house dust mite) | *Der p* 1.0108 | No | Cysteine protease | / | P08176 (variant) | 941 |
| *Dermatophagoides pteronyssinus* (European house dust mite) | *Der p* 1.0109 | No | Cysteine protease | / | P08176 (variant) | 940 |

TABLE 5-continued

Allergen proteins

| Species | Allergen | Food Allergen | Biochemical name | GenBank | Uniprot | SEQ ID NO |
|---|---|---|---|---|---|---|
| *Dermatophagoides pteronyssinus* (European house dust mite) | *Der p* 1.0110 | No | Cysteine protease | / | P08176 (variant) | 941 |
| *Dermatophagoides pteronyssinus* (European house dust mite) | *Der p* 1.0111 | No | Cysteine protease | / | P08176 (variant) | 940 |
| *Dermatophagoides pteronyssinus* (European house dust mite) | *Der p* 1.0112 | No | Cysteine protease | / | P08176 (variant) | 940 |
| *Dermatophagoides pteronyssinus* (European house dust mite) | *Der p* 1.0113 | No | Cysteine protease | ABA39435 | Q3HWZ5 (variant) | 942 |
| *Dermatophagoides pteronyssinus* (European house dust mite) | *Der p* 1.0114 | No | Cysteine protease | / | Q3HWZ5 (variant) | 942 |
| *Dermatophagoides pteronyssinus* (European house dust mite) | *Der p* 1.0115 | No | Cysteine protease | / | Q3HWZ5 (variant) | 943 |
| *Dermatophagoides pteronyssinus* (European house dust mite) | *Der p* 1.0116 | No | Cysteine protease | / | Q3HWZ5 (variant) | 942 |
| *Dermatophagoides pteronyssinus* (European house dust mite) | *Der p* 1.0117 | No | Cysteine protease | / | Q3HWZ5 (variant) | 943 |
| *Dermatophagoides pteronyssinus* (European house dust mite) | *Der p* 1.0118 | No | Cysteine protease | / | Q3HWZ5 (variant) | 942 |
| *Dermatophagoides pteronyssinus* (European house dust mite) | *Der p* 1.0119 | No | Cysteine protease | / | Q3HWZ5 (variant) | 943 |
| *Dermatophagoides pteronyssinus* (European house dust mite) | *Der p* 1.0120 | No | Cysteine protease | / | Q3HWZ5 (variant) | 943 |
| *Dermatophagoides pteronyssinus* (European house dust mite) | *Der p* 1.0121 | No | Cysteine protease | / | Q3HWZ5 (variant) | 943 |
| *Dermatophagoides pteronyssinus* (European house dust mite) | *Der p* 1.0122 | No | Cysteine protease | / | Q3HWZ5 (variant) | 943 |
| *Dermatophagoides pteronyssinus* (European house dust mite) | *Der p* 1.0123 | No | Cysteine protease | / | Q3HWZ5 (variant) | 943 |
| *Dermatophagoides pteronyssinus* (European house dust mite) | *Der p* 1.0124 | No | Cysteine protease | CAQ68250 | C7T6L6 | 944 |
| *Dermatophagoides pteronyssinus* (European house dust mite) | *Der p* 2.0101 | No | NPC2 family | AAF86462 | P49278 | 945 |
| *Dermatophagoides pteronyssinus* (European house dust mite) | *Der p* 2.0102 | No | NPC2 family | / | P49278 (variant) | 946 |
| *Dermatophagoides pteronyssinus* (European house dust mite) | *Der p* 2.0103 | No | NPC2 family | / | P49278 (variant) | 946 |

TABLE 5-continued

Allergen proteins

| Species | Allergen | Food Allergen | Biochemical name | GenBank | Uniprot | SEQ ID NO |
|---|---|---|---|---|---|---|
| *Dermatophagoides pteronyssinus* (European house dust mite) | *Der p* 2.0104 | No | NPC2 family | / | P49278 (variant) | 945 |
| *Dermatophagoides pteronyssinus* (European house dust mite) | *Der p* 2.0105 | No | NPC2 family | / | P49278 (variant) | 946 |
| *Dermatophagoides pteronyssinus* (European house dust mite) | *Der p* 2.0106 | No | NPC2 family | / | P49278 (variant) | 945 |
| *Dermatophagoides pteronyssinus* (European house dust mite) | *Der p* 2.0107 | No | NPC2 family | / | P49278 (variant) | 945 |
| *Dermatophagoides pteronyssinus* (European house dust mite) | *Der p* 2.0108 | No | NPC2 family | / | P49278 (variant) | 946 |
| *Dermatophagoides pteronyssinus* (European house dust mite) | *Der p* 2.0110 | No | NPC2 family | CAQ68249 | C7T6L5 | 947 |
| *Dermatophagoides pteronyssinus* (European house dust mite) | *Der p* 2.0114 | No | NPC2 family | CAK22338 | Q1H8P8 | 948 |
| *Dermatophagoides pteronyssinus* (European house dust mite) | *Der p* 2.0115 | No | NPC2 family | CAQ68249 | C7T6L5 | 947 |
| *Dermatophagoides pteronyssinus* (European house dust mite) | *Der p* 3 | No | Trypsin | AAA19973 | P39675 | 949 |
| *Dermatophagoides pteronyssinus* (European house dust mite) | *Der p* 4 | No | Alpha amylase | AAD38942 | Q9Y197 | 950 |
| *Dermatophagoides pteronyssinus* (European house dust mite) | *Der p* 5.0101 | No | / | CAA35692 | P14004 | 951 |
| *Dermatophagoides pteronyssinus* (European house dust mite) | *Der p* 5.0102 | No | / | AAB32842 | P14004 | 952 |
| *Dermatophagoides pteronyssinus* (European house dust mite) | *Der p* 6 | No | Chymotrypsin | P49277 | P49277 | 953 |
| *Dermatophagoides pteronyssinus* (European house dust mite) | *Der p* 7 | No | Bactericidal permeability-increasing like protein | AAA80264 | P49273 | 954 |
| *Dermatophagoides pteronyssinus* (European house dust mite) | *Der p* 8 | No | Glutathione S-transferase | AAB32224 | P46419 | 955 |
| *Dermatophagoides pteronyssinus* (European house dust mite) | *Der p* 9.0101 | No | Collagenolytic serine protease | AAP57077 | Q7Z163 | 956 |
| *Dermatophagoides pteronyssinus* (European house dust mite) | *Der p* 9.0102 | No | Collagenolytic serine protease | AAN02511 | Q8MWR4 | 957 |
| *Dermatophagoides pteronyssinus* (European house dust mite) | *Der p* 10 | No | Tropomyosin | CAA75141 | O18416 | 958 |

TABLE 5-continued

Allergen proteins

| Species | Allergen | Food Allergen | Biochemical name | GenBank | Uniprot | SEQ ID NO |
|---|---|---|---|---|---|---|
| *Dermatophagoides pteronyssinus* (European house dust mite) | Der p 11 | No | Paramyosin | AAO73464 | Q6Y2F9 | 959 |
| *Dermatophagoides pteronyssinus* (European house dust mite) | Der p 13 | No | Cytosolic Fatty Acid Binding Protein | ADK92390 | E0A8N8 | 960 |
| *Dermatophagoides pteronyssinus* (European house dust mite) | Der p 14 | No | Apolipophorin | AAM21322 | Q8N0N0 | 961 |
| *Dermatophagoides pteronyssinus* (European house dust mite) | Der p 15.0101 | No | Chitinase-like protein | AAY84565 | Q4JK69 | 962 |
| *Dermatophagoides pteronyssinus* (European house dust mite) | Der p 15.0201 | No | Chitinase-like protein | AAY84564 | Q4JK70 | 963 |
| *Dermatophagoides pteronyssinus* (European house dust mite) | Der p 18 | No | Chitin-binding protein | AAY84563 | Q4JK71 | 964 |
| *Dermatophagoides pteronyssinus* (European house dust mite) | Der p 20 | No | Arginine kinase | ACD50950 | B2ZSY4 | 965 |
| *Dermatophagoides pteronyssinus* (European house dust mite) | Der p 21 | No | / | ABC73706 | Q2L7C5 | 966 |
| *Dermatophagoides pteronyssinus* (European house dust mite) | Der p 23 | No | Peritrophin-like protein domain (PF01607) | ACB46292 | L7N6F8 | 967 |
| *Dermatophagoides pteronyssinus* (European house dust mite) | Der p 24 | No | biquinol-cytochrome c reductase binding protein | ALA65345.1 | A0A0K2GUJ4 | 968 |
| *Dolichovespula arenaria* (Yellow hornet) | Dol a 5 | No | Antigen 5 | AAA28303 | Q05108 | 969 |
| *Dolichovespula maculata* (White face hornet) | Dol m 1.0101 | No | Phospholipase A1B | CAA47341 | Q06478 | 970 |
| *Dolichovespula maculata* (White face hornet) | Dol m 1.0102 | No | Phospholipase A1B | P53357 | P53357 | 971 |
| *Dolichovespula maculata* (White face hornet) | Dol m 2 | No | Hyaluronidase | AAA68279 | P49371 | 972 |
| *Dolichovespula maculata* (White face hornet) | Dol m 5.0101 | No | Venom Antigen 5 | AA28301 | P10736 | 973 |
| *Dolichovespula maculata* (White face hornet) | Dol m 5.0102 | No | Venom Antigen 5 | AAA28302 | P10737 | 974 |
| *Eriocheir sinensis* (*Eriocheir sinensis*) | Eri s 2 | Yes | ovary development-related protein | AAO73305 | Q5QKR2 | 975 |
| *Euroglyphus maynei* (House dust mite) | Eur m 1.0101 | No | Cysteine protease | AAC82351 | P25780 | 976 |
| *Euroglyphus maynei* (House dust mite) | Eur m 1.0102 | No | Cysteine protease | / | P25780 (variant) | 976 |
| *Euroglyphus maynei* (House dust mite) | Eur m 2.0101 | No | NPC2 family | AAC8234 | Q9TZZ2 | 977 |
| *Euroglyphus maynei* (House dust mite) | Eur m 2.0102 | No | NPC2 family | AC82350 | Q9TZZ2 (variant) | 977 |
| *Euroglyphus maynei* (House dust mite) | Eur m 3 | No | Trypsin | AAD10712 | O97370 | 978 |
| *Euroglyphus maynei* (House dust mite) | Eur m 4 | No | Alpha-amylase | AAD38943 | Q9Y196 | 979 |
| *Euroglyphus maynei* (House dust mite) | Eur m 14 | No | Apolipophorin | AAF14270 | Q9U785 | 980 |

TABLE 5-continued

Allergen proteins

| Species | Allergen | Food Allergen | Biochemical name | GenBank | Uniprot | SEQ ID NO |
|---|---|---|---|---|---|---|
| *Forcipomyia taiwana* (Biting midge) | *For t* 1 | No | Serine/threonine-protein kinase | ACD65080 | B2ZPG6 | 981 |
| *Forcipomyia taiwana* (Biting midge) | *For t* 2 | No | Eukaryotic translation initiation factor 3 subunit | ACD65081 | B2ZPG7 | 982 |
| *Glossina morsitans* (Savannah Tsetse Fly) | *Glo m* 5 | No | Tsetse antigen 5, CAP protein superfamily member | AAF82096 | Q9NBA6 | 983 |
| *Glycyphagus domesticus* (Storage mite) | *Gly d* 2.0101 | No | Mite group 2 allergen | CAB5997 | Q9U5P7 | 984 |
| *Glycyphagus domesticus* (Storage mite) | *Gly d* 2.0201 | No | Mite group 2 allergen | CAB76459 | Q9NFQ4 | 985 |
| *Harmonia axyridis* (Asian ladybeetle) | *Har a* 1 | No | / | / | / | / |
| *Harmonia axyridis* (Asian ladybeetle) | *Har a* 2 | No | aldehyde dehydrogenase | / | / | / |
| *Homarus americanus* (American lobster) | *Hom a* 1.0101 | Yes | Tropomyosin | AAC48287 | O44119-1 | 986 |
| *Homarus americanus* (American lobster) | *Hom a* 1.0102 | Yes | Tropomyosin | AAC48288 | O44119-2 | 987 |
| *Homarus americanus* (American lobster) | *Hom a* 3 | Yes | Myosin light chain 2 | / | / | / |
| *Homarus americanus* (American lobster) | *Hom a* 6 | Yes | Troponin C | P29291 | P29291 | 988 |
| *Lepidoglyphus destructor* (Storage mite) | *Lep d* 2.0101 | No | / | CAA61419 | P80384 | 989 |
| *Lepidoglyphus destructor* (Storage mite) | *Lep d* 2.0102 | No | / | CAD32313 | P80384 (variant) | 990 |
| *Lepidoglyphus destructor* (Storage mite) | *Lep d* 2.0201 | No | / | CAA58755 | P80384 (variant) | 991 |
| *Lepidoglyphus destructor* (Storage mite) | *Lep d* 2.0202 | No | / | CAD32314 | P80384 (variant) | 992 |
| *Lepidoglyphus destructor* (Storage mite) | *Lep d* 5.0101 | No | / | CAB62212 | Q9U5P2 | 993 |
| *Lepidoglyphus destructor* (Storage mite) | *Lep d* 5.0102 | No | / | AAQ73493 | Q1M2N1 | 994 |
| *Lepidoglyphus destructor* (Storage mite) | *Lep d* 5.0103 | No | / | AAQ73494 | Q1M2N0 | 995 |
| *Lepidoglyphus destructor* (Storage mite) | *Lep d* 7 | No | Bactericidal permeability-increasing like protein | CAB65963 | Q9U1G2 | 996 |
| *Lepidoglyphus destructor* (Storage mite) | *Lep d* 10 | No | Tropomyosin | CAB71342 | Q9NFZ4 | 997 |
| *Lepidoglyphus destructor* (Storage mite) | *Lep d* 13 | No | Fatty acid-binding protein | CAB62213 | Q9U5P1 | 998 |
| *Lepisma saccharina* (Silverfish) | *Lep s* 1 | No | Tropomyosin | CAC84590 | Q8T380 | 999 |
| *Liposcelis bostrychophila* (Booklouse) | *Lip b* 1 | No | unknown function | P86712 | P86712 | 1000 |
| *Litopenaeus vannamei* (White shrimp) | *Lit v* 1 | Yes | Tropomyosin | ACB38288 | B4YAH6 | 1001 |
| *Litopenaeus vannamei* (White shrimp) | *Lit v* 2 | Yes | Arginine kinase | ABI98020 | Q004B5 | 1002 |
| *Litopenaeus vannamei* (White shrimp) | *Lit v* 3 | Yes | Myosin, light chain 2 | ACC76803 | B7SNI3 | 1003 |
| *Litopenaeus vannamei* (White shrimp) | *Lit v* 4 | Yes | Sarcoplasmic calcium-binding protein | ACM89179 | C7A639 | 1004 |
| *Macrobrachium rosenbergii* (giant freshwater prawn) | *Mac r* 1 | Yes | tropomyosin | ADC55380 | D3XNR9 | 1005 |
| *Melicertus latisulcatus* (King Prawn) | *Mel l* 1 | Yes | tropomyosin | AGF86397 | M4M2H6 | 1006 |
| *Metapenaeus ensis* (Shrimp) | *Met e* 1 | Yes | tropomyosin | AAA60330 | Q25456 | 1007 |

TABLE 5-continued

Allergen proteins

| Species | Allergen | Food Allergen | Biochemical name | GenBank | Uniprot | SEQ ID NO |
|---|---|---|---|---|---|---|
| *Myrmecia pilosula* (Australian jumper ant) | *Myr p* 1 | No | Pilosulin-1 | CAA49760 | Q07932 | 1008 |
| *Myrmecia pilosula* (Australian jumper ant) | *Myr p* 2 | No | pilosulin-3a | AAB36316 | Q26464 | 1009 |
| *Myrmecia pilosula* (Australian jumper ant) | *Myr p* 3 | No | pilosulin-4.1 | BAD36780 | Q68Y22 | 1010 |
| *Pachycondyla chinensis* (Asian needle ant) | *Pac c* 3 | No | Antigen 5 | ACA96507.1 | C0ITL3 | 1011 |
| *Pandalus borealis* (Northern shrimp) | *Pan b* 1 | Yes | Tropomyosin | CBY17558 | E5BBS3 | 1012 |
| *Panulirus stimpsoni* (Spiny lobster) | *Pan s* 1 | Yes | Tropomyosin | AAC38996 | O61379 | 1013 |
| *Penaeus aztecus* (Brown shrimp) | *Pen a* 1 | Yes | Tropomyosin | AAZ76743 | Q3Y8M6 | 1014 |
| *Penaeus indicus* (Shrimp) | *Pen i* 1 | Yes | Tropomyosin | / | / | / |
| *Penaeus monodon* (Black tiger shrimp) | *Pen m* 1 | Yes | tropomyosin | ADM34184 | A1KYZ2 | 1014 |
| *Penaeus monodon* (Black tiger shrimp) | *Pen m* 2 | Yes | arginine kinase | AAO15713 | Q8I9P7 | 1015 |
| *Penaeus monodon* (Black tiger shrimp) | *Pen m* 3 | Yes | Myosin light chain 2 | ADM34185 | E1A683 | 1016 |
| *Penaeus monodon* (Black tiger shrimp) | *Pen m* 4 | Yes | Sarcoplasmic calcium binding protein | ADV17343 | E7CGC4 | 1004 |
| *Penaeus monodon* (Black tiger shrimp) | *Pen m* 6 | Yes | Troponin C | ADV17344 | E7CGC5 | 1017 |
| *Periplaneta americana* (American cockroach) | *Per a* 1.0101 | No | Cr-PII allergen | AAD13533 | Q9TZR6 | 1018 |
| *Periplaneta americana* (American cockroach) | *Per a* 1.0102 | No | Cr-PII allergen | AAC34312 | O18535 | 1019 |
| *Periplaneta americana* (American cockroach) | *Per a* 1.0103 | No | Cr-PII allergen | AAB82404 | O18530 | 1020 |
| *Periplaneta americana* (American cockroach) | *Per a* 1.0104 | No | Cr-PII allergen | AAC34737 | O18528 | 1021 |
| *Periplaneta americana* (American cockroach) | *Per a* 1.0201 | No | Cr-PII allergen | AAC34736 | O18527 | 1022 |
| *Periplaneta americana* (American cockroach) | *Per a* 2 | No | aspartatic protease-like | ADR82198 | E7BQV5 | 1023 |
| *Periplaneta americana* (American cockroach) | *Per a* 3.0101 | No | Arylphorins/TO Arthropod hemocyanins (Cr-PI Allergen) | AAB09629 | Q25641 | 1024 |
| *Periplaneta americana* (American cockroach) | *Per a* 3.0201 | No | Arylphorins/TO Arthropod hemocyanins (Cr-PI Allergen) | AAB09632 | Q94643 | 1025 |
| *Periplaneta americana* (American cockroach) | *Per a* 3.0202 | No | Arylphorins/TO Arthropod hemocyanins (Cr-PI Allergen) | AAB62731 | Q25640 | 1026 |
| *Periplaneta americana* (American cockroach) | *Per a* 3.0203 | No | Arylphorins/TO Arthropod hemocyanins (Cr-PI Allergen) | AAB63595 | Q25639 | 1027 |
| *Periplaneta americana* (American cockroach) | *Per a* 6 | No | Troponin C | AAX33730 | Q1M0Y3 | 1028 |
| *Periplaneta americana* (American cockroach) | *Per a* 7 | No | Tropomyosin | CAB38086 | Q9UB83 | 1029 |
| *Periplaneta americana* (American cockroach) | *Per a* 9 | No | Arginine kinase | ACA00204 | / | 1030 |
| *Periplaneta americana* (American cockroach) | *Per a* 10 | No | Serine protease | AAX33734 | Q1M0X9 | 1031 |
| *Periplaneta americana* (American cockroach) | *Per a* 11 | No | alpha amylase | AKH04310 | / | 1032 |
| *Periplaneta americana* (American cockroach) | *Per a* 12 | No | Chitinase | AKH04311 | / | 1033 |
| *Plodia interpunctella* (Indianmeal moth) | *Plo i* 1 | No | Arginine kinase | CAC85911 | Q95PM9 | 1034 |
| *Plodia interpunctella* (Indianmeal moth) | *Plo i* 2 | No | Thioredoxin | CBW45298 | E1XUQ3 | 1035 |
| *Polistes annularis* (Wasp) | *Pol a* 1 | No | Phospholipase A1B | AD52615 | Q9U6W0 | 1036 |
| *Polistes annularis* (Wasp) | *Pol a* 2 | No | Hyaluronidase | AAD52616 | Q9U6V9 | 1037 |
| *Polistes annularis* (Wasp) | *Pol a* 5 | No | Antigen 5 | AAA29793 | Q05109 | 1038 |
| *Polistes dominulus* (Mediterranean paper wasp) | *Pol d* 1.0101 | No | Phospholipase A1-1 | AAS67041 | Q6Q252 | 1039 |

TABLE 5-continued

Allergen proteins

| Species | Allergen | Food Allergen | Biochemical name | GenBank | Uniprot | SEQ ID NO |
|---|---|---|---|---|---|---|
| *Polistes dominulus* (Mediterranean paper wasp) | *Pol d* 1.0102 | No | Phospholipase A1-2 | AAS67042 | Q6Q251 | 1040 |
| *Polistes dominulus* (Mediterranean paper wasp) | *Pol d* 1.0103 | No | Phospholipase A1-3 | AAS67043 | Q6Q250 | 1041 |
| *Polistes dominulus* (Mediterranean paper wasp) | *Pol d* 1.0104 | No | Phospholipase A1-4 | AAS67044 | Q6Q249 | 1042 |
| *Polistes dominulus* (Mediterranean paper wasp) | *Pol d* 4 | No | Serine protease | AAP37412 | Q7Z269 | 1043 |
| *Polistes dominulus* (Mediterranean paper wasp) | *Pol d* 5 | No | Antigen 5 | AAT95010 | Q68KJ8 | 1044 |
| *Polistes exclamans* (Wasp) | *Pol e* 1 | No | Phospholipase A1 | / | / | / |
| *Polistes exclamans* (Wasp) | *Pol e* 4 | No | Serine protease | / | / | / |
| *Polistes exclamans* (Wasp) | *Pol e* 5 | No | Antigen 5 | AAT95009 | Q68KJ9 | 1045 |
| *Polistes fuscatus* (Wasp) | *Pol f* 5 | No | Antigen 5 | P35780 | P35780 | 1046 |
| *Polistes gallicus* (Wasp) | *Pol g* 1 | No | Phospholipase A1 | P83542 | P83542 | 1047 |
| *Polistes gallicus* (Wasp) | *Pol g* 5 | No | Antigen 5 | P83377 | P83377 | 1048 |
| *Polistes metricus* (Wasp) | *Pol m* 5 | No | Antigen 5 | P35780 | P35780 | 1046 |
| *Polybia paulista* (Wasp) | *Poly p* 1 | No | Phospholipase A1 | ABN13879 | A2VBC4 | 1049 |
| *Polybia paulista* (Wasp) | *Poly p* 2 | No | Hyaluronidase | / | P86687 | 1050 |
| *Polybia paulista* (Wasp) | *Poly p* 5.0101 | No | Venom group 5 | / | C0HJV9 | / |
| *Polybia paulista* (Wasp) | *Poly p* 5.0102 | No | Venom group 5 | / | P86686 | 1051 |
| *Polybia scutellaris* (Wasp) | *Poly s* 5 | No | | / | / | / |
| *tastacus leptodactylus* (Narrow-clawed crayfish) | *Pon l* 4 | Yes | Sarcoplasmic calcium-binding protein | P05946 | P05946 | 1052 |
| *tastacus leptodactylus* (Narrow-clawed crayfish) | *Pon l* 7 | Yes | Troponin I | P05547 | P05547 | 1053 |
| *Portunus pelagicus* (Blue swimmer crab) | *Por p* 1 | Yes | Tropomyosin | AGE44125 | M1H607 | 1054 |
| *Solenopsis geminata* (Tropical fire ant) | *Sol g* 2 | No | / | / | / | / |
| *Solenopsis geminata* (Tropical fire ant) | *Sol g* 3 | No | / | / | / | / |
| *Solenopsis geminata* (Tropical fire ant) | *Sol g* 4 | No | / | AAF65312 | Q9NH75 | 1055 |
| *Solenopsis invicta* (Red imported fire ant) | *Sol i* 1 | No | Phospholipase A1B | AAT95008 | Q68KK0 | 1056 |
| *Solenopsis invicta* (Red imported fire ant) | *Sol i* 2 | No | / | P35775 | P35775 | 1057 |
| *Solenopsis invicta* (Red imported fire ant) | *Sol i* 3 | No | / | AAB65434 | P35778 | 1058 |
| *Solenopsis invicta* (Red imported fire ant) | *Sol i* 4 | No | / | AAC97369 | P35777 | 1059 |
| *Solenopsis richteri* (Black fire ant) | *Sol r* 2 | No | / | P35776 | P35776 | 1060 |
| *Solenopsis richteri* (Black fire ant) | *Sol r* 3 | No | / | P35779 | P35779 | 1061 |
| *Solenopsis saevissima* (Brazilian fire ant) | *Sol s* 2 | No | / | ABC58726 | A5X2H7 | 1062 |
| *Solenopsis saevissima* (Brazilian fire ant) | *Sol s* 3 | No | / | / | / | / |
| *Tabanus yao* (Horsefly) | *Tab y* 1 | No | Apyrase | ADX78255 | F1JZ10 | 1063 |
| *Tabanus yao* (Horsefly) | *Tab y* 2 | No | Hyaluronidase | ADM18346 | E0XKJ9 | 1064 |
| *Tabanus yao* (Horsefly) | *Tab y* 5 | No | Antigen 5-related protein, CAP protein superfamily member | ADM18345 | E0XKJ8 | 1065 |
| *Thaumetopoea pityocampa* (Pine processionary moth) | *Tha p* 1 | No | / | Q7M4K8 | Q7M4K8 | 1066 |

TABLE 5-continued

| Species | Allergen | Food Allergen | Biochemical name | GenBank | Uniprot | SEQ ID NO |
|---|---|---|---|---|---|---|
| *Thaumetopoea pityocampa* (Pine processionary moth) | Tha p 2 | No | / | P86360 | P86360 | 1067 |
| *Triatoma protracta* (California kissing bug) | Tria p 1 | No | Procalin | AAF07903 | Q9U6R6 | 1068 |
| *Tyrophagus putrescentiae* (Storage mite) | Tyr p 2 | No | NPC2 family | CAA73221 | O02380 | 1069 |
| *Tyrophagus putrescentiae* (Storage mite) | Tyr p 3 | No | Trypsin | ABZ81991 | C6ZDB5 | 1070 |
| *Tyrophagus putrescentiae* (Storage mite) | Tyr p 10 | No | Tropomyosin | AAT40866 | Q6IUP9 | 1071 |
| *Tyrophagus putrescentiae* (Storage mite) | Tyr p 13 | No | Fatty-acid binding protein | AAU11502 | Q66RP5 | 1072 |
| *Tyrophagus putrescentiae* (Storage mite) | Tyr p 28 | No | Heat shock protein | AOD75395.1 | / | 1073 |
| *Tyrophagus putrescentiae* (Storage mite) | Tyr p 34 | No | Troponin C | ACL36923 | D2DGW3 | 1074 |
| *Tyrophagus putrescentiae* (Storage mite) | Tyr p 35 | No | Aldehyde dehydrogenase | AOD75396.1 | / | 1075 |
| *Tyrophagus putrescentiae* (Storage mite) | Tyr p 36 | No | Profilin | AOD75399.1 | / | 1076 |
| *Vespa crabro* (European hornet) | Vesp c 1 | No | Phospholipase A1B | P0CH87 | P0CH87 | 1077 |
| *Vespa crabro* (European hornet) | Vesp c 5.0101 | No | Antigen 5 | P35781 | P35781 | 1078 |
| *Vespa crabro* (European hornet) | Vesp c 5.0102 | No | Antigen 5 | P35782 | P35782 | 1079 |
| *Vespa magnifica* (Hornet) | Vesp ma 2 | No | Hyaluronidase | / | / | / |
| *Vespa magnifica* (Hornet) | Vesp ma 5 | No | Antigen 5, member of PR-1 family | / | / | / |
| *Vespa mandarinia* (Giant asian hornet) | Vesp m 1 | No | Phospholipase A1B | / | / | / |
| *Vespa mandarinia* (Giant asian hornet) | Vesp m 5 | No | Antigen 5 | P81657 | P81657 | 1080 |
| *Vespula flavopilosa* (Yellow jacket) | Ves f 5 | No | Antigen 5 | P35783 | P35783 | 1081 |
| *Vespula germanica* (Yellow jacket) | Ves g 5 | No | Antigen 5 | CAJ28930 | P35784 | 1082 |
| *Vespula maculifrons* (Yellow jacket) | Ves m 1 | No | Phospholipase A1B | P51528 | P51528 | 1083 |
| *Vespula maculifrons* (Yellow jacket) | Ves m 2 | No | Hyaluronidase | P0CH89 | P0CH89 | 1084 |
| *Vespula maculifrons* (Yellow jacket) | Ves m 5 | No | Antigen 5 | P35760 | P35760 | 1085 |
| *Vespula pensylvanica* (Yellow jacket) | Ves p 5 | No | Antigen 5 | P35785 | P35785 | 1086 |
| *Vespula squamosa* (Yellow jacket) | Ves s 1 | No | Phospholipase A1B | P0CH86 | P0CH86 | 1087 |
| *Vespula squamosa* (Yellow jacket) | Ves s 5 | No | Antigen 5 | P35786 | P35786 | 1088 |
| *Vespula vidua* (Wasp) | Ves vi 5 | No | Antigen 5 | P35787 | P35787 | 1089 |
| *Vespula vulgaris* (Yellow jacket) | Ves v 1 | No | Phospholipase A1B | AAB48072 | P49369 | 1090 |
| *Vespula vulgaris* (Yellow jacket) | Ves v 2.0101 | No | Hyaluronidase | CAI77218 | P49370 | 1091 |
| *Vespula vulgaris* (Yellow jacket) | Ves v 2.0201 | No | Hyaluronidase | AAX14718 | Q5D7H4 | 1092 |
| *Vespula vulgaris* (Yellow jacket) | Ves v 3 | No | Dipeptidylpeptidase IV | ACA00159 | B1A4F7 | 1093 |
| *Vespula vulgaris* (Yellow jacket) | Ves v 5 | No | Antigen 5 | AAA30333 | Q05110 | 1094 |
| *Vespula vulgaris* | Ves v 6 | No | Vitellogenin | AER70365 | G8IIT0 | 1095 |

TABLE 5-continued

Allergen proteins

| Species | Allergen | Food Allergen | Biochemical name | GenBank | Uniprot | SEQ ID NO |
|---|---|---|---|---|---|---|
| (Yellow jacket) | | | | | | |
| | | | Animalia Chordata | | | |
| Bos domesticus Bos taurus (domestic cattle) | Bos d 2.0101 | No | Lipocalin | AAB08720 | Q28133 | 1096 |
| Bos domesticus Bos taurus (domestic cattle) | Bos d 2.0102 | No | Lipocalin | NP_777186 | Q28133 | 1097 |
| Bos domesticus Bos taurus (domestic cattle) | Bos d 3 | No | S100 calcium-binding protein A7 | AAA91101 | Q28050 | 1098 |
| Bos domesticus Bos taurus (domestic cattle) | Bos d 4 | Yes | Alpha-lactalbumin | AAA30615 | P00711 | 1099 |
| Bos domesticus Bos taurus (domestic cattle) | Bos d 5 | Yes | Beta-lactoglobulin | CAA32835 | P02754 | 1100 |
| Bos domesticus Bos taurus (domestic cattle) | Bos d 6 | Yes | Serum albumin | AAA51411 | P02769 | 1101 |
| Bos domesticus Bos taurus (domestic cattle) | Bos d 7 | Yes | Immunoglobulin | / | / | / |
| Bos domesticus Bos taurus (domestic cattle) | Bos d 8 | Yes | Caseins (see individual casein 9-12) | / | / | / |
| Bos domesticus Bos taurus (domestic cattle) | Bos d 9 | Yes | alphaS1-casein | NP_851372 | P02662 | 1102 |
| Bos domesticus Bos taurus (domestic cattle) | Bos d 10 | Yes | alphaS2-casein | NP_776953 | P02663 | 1103 |
| Bos domesticus Bos taurus (domestic cattle) | Bos d 11 | Yes | beta-casein | XP_005902099 | P02666 | 1104 |
| Bos domesticus Bos taurus (domestic cattle) | Bos d 12 | Yes | kappa-casein | NP_776719 | P02668 | 1105 |
| Canis familiaris (dog) | Can f 1 | No | Lipocalin | AAC48794 | O18873 | 1106 |
| Canis familiaris (dog) | Can f 2 | No | Lipocalin | AAC48795 | O18874 | 1107 |
| Canis familiaris (dog) | Can f 3 | No | Serum albumin | BAC10663 | P49822 | 1108 |
| Canis familiaris (dog) | Can f 4 | No | Lipocalin | ACY38525 | D7PBH4 | 1109 |
| Canis familiaris (dog) | Can f 5 | No | Arginine esterase, prostatic kallikrein | CAA68720 | P09582 | 1110 |
| Canis familiaris (dog) | Can f 6 | No | Lipocalin | CCF72371 | H2B3G5 | 1111 |
| Canis familiaris (dog) | Can f 7 | No | Epididymal Secretory Protein E1, or Niemann Pick type C2 protein | AAB34263.1 | Q28895 | 1112 |
| Cavia porcellus (guinea pig) | Cav p 1 | No | Lipocalin | P83507 | P83507 | 1113 |
| Cavia porcellus (guinea pig) | Cav p 2 | No | Lipocalin | CAX62129 | F0UZ11 | 1114 |
| Cavia porcellus (guinea pig) | Cav p 3 | No | Lipocalin | CAX62130 | F0UZ12 | 1115 |
| Cavia porcellus (guinea pig) | Cav p 4 | No | Serum albumin | AAQ20088 | Q6WDN9 | 1116 |
| Cavia porcellus (guinea pig) | Cav p 6 | No | Lipocalin | CAX62131 | S0BDX9 | 1117 |
| Clupea harengus (Atlantic herring) | Clu h 1.0101 | Yes | Beta-parvalbumin | CAQ72970 | C6GKU6 | 1118 |
| Clupea harengus (Atlantic herring) | Clu h 1.0201 | Yes | Beta-parvalbumin | CAQ72971 | C6GKU7 | 1119 |
| Clupea harengus (Atlantic herring) | Clu h 1.0301 | Yes | Beta-parvalbumin | CAQ72972 | C6GKU8 | 1120 |
| Cyprinus carpio (Common carp) | Cyp c 1.0101 | Yes | beta-parvalbumin | CAC83658 | Q8UUS3 | 1121 |
| Cyprinus carpio (Common carp) | Cyp c 1.0201 | Yes | beta-parvalbumin | CAC83659 | Q8UUS2 | 1122 |
| Equus caballus (domestic horse) | Equ c 1 | No | Lipocalin | AAC48691 | Q95182 | 1123 |
| Equus caballus (domestic horse) | Equ c 2.0101 | No | Lipocalin | P81216 | P81216 | 1124 |
| Equus caballus (domestic horse) | Equ c 2.0102 | No | Lipocalin | P81217 | P81217 | 1125 |
| Equus caballus (domestic horse) | Equ c 3 | No | Serum albumin | CAA52194 | P35747 | 1126 |
| Equus caballus (domestic horse) | Equ c 4 | No | Latherin | AAM09530 | P82615 | 1127 |
| Felis domesticus (cat) | Fel d 1 | No | Uteroglobin (chain 1) | AAC37318 (chain 1) | P30438 (chain 1) | 1128 |
| Felis domesticus (cat) | Fel d 1 | No | Uteroglobin (chain 2) | AAC41616 (chain 2) | P30440 (chain 2) | 1129 |
| Felis domesticus (cat) | Fel d 2 | No | Serum albumin | CAA59279 | P49064 | 1130 |
| Felis domesticus (cat) | Fel d 3 | No | Cystatin | AAL49391 | Q8WNR9 | 1131 |
| Felis domesticus (cat) | Fel d 4 | No | Lipocalin | AAS77253 | Q5VFH6 | 1132 |
| Felis domesticus (cat) | Fel d 5w | No | Immunoglobulin A | / | / | / |

TABLE 5-continued

Allergen proteins

| Species | Allergen | Food Allergen | Biochemical name | GenBank | Uniprot | SEQ ID NO |
|---|---|---|---|---|---|---|
| *Felis domesticus* (cat) | Fel d 6w | No | Immunoglobulin M | / | / | / |
| *Felis domesticus* (cat) | Fel d 7 | No | von Ebner gland protein | ADK56160 | E5D2Z5 | 1133 |
| *Felis domesticus* (cat) | Fel d 8 | No | Latherin-like protein | ADM15668 | F6K0R4 | 1134 |
| *Gadus callarias* (Baltic cod) | Gad c 1 | Yes | Beta-parvalbumin | P02622 | P02622 | 1135 |
| *Gadus morhua* (Atlantic cod) | Gad m 1.0101 | Yes | Beta-parvalbumin | AAK63086 | Q90YL0 | 1136 |
| *Gadus morhua* (Atlantic cod) | Gad m 1.0102 | Yes | Beta-parvalbumin | CAM56785 | A5I873 | 1137 |
| *Gadus morhua* (Atlantic cod) | Gad m 1.0201 | Yes | Beta-parvalbumin | AAK63087 | Q90YK9 | 1138 |
| *Gadus morhua* (Atlantic cod) | Gad m 1.0202 | Yes | Beta-parvalbumin | CAM56786 | A5I874 | 1139 |
| *Gadus morhua* (Atlantic cod) | Gad m 2 | Yes | Beta-enolase | B3A0L6 | B3A0L6 | 1140 |
| *Gadus morhua* (Atlantic cod) | Gad m 3 | Yes | Fructose-bisphosphate aldolase A | P86980 | P86980 | 1141 |
| *Gallus domesticus* (chicken) | Gal d 1 | Yes | Ovomucoid | P01005 | P01005 | 1142 |
| *Gallus domesticus* (chicken) | Gal d 2 | Yes | Ovalbumin | CAA23682 | P01012 | 1143 |
| *Gallus domesticus* (chicken) | Gal d 3 | Yes | Ovotransferrin | CAA26040 | P02789 | 1144 |
| *Gallus domesticus* (chicken) | Gal d 4 | Yes | Lysozyme C | CAA23711 | P00698 | 1145 |
| *Gallus domesticus* (chicken) | Gal d 5 | Yes | Serum albumin | CAA43098 | P19121 | 1146 |
| *Gallus domesticus* (chicken) | Gal d 6 | Yes | YGP42 | BAA13973 | P87498 | 1147 |
| *Gallus domesticus* (chicken) | Gal d 7 | Yes | Myosin light chain 1f | K02610.1 | P02604 | 1148 |
| *Gallus domesticus* (chicken) | Gal d 8 | Yes | alpha-parvalbumin | CAX32963 | C1L370 | 1149 |
| *Gallus domesticus* (chicken) | Gal d 9 | Yes | Beta-enolase | NP_990450 | P07322 | 1150 |
| *Gallus domesticus* (chicken) | Gal d 10 | Yes | Aldolase | / | / | / |
| *Homo sapiens* (human autoallergens) | Hom s 1 | No | Squamous cell carcinoma antigen SART-1 | BAA24056 | O43290 | 1151 |
| *Homo sapiens* (human autoallergens) | Hom s 2 | No | Nascent polypeptide-associated complex alpha subunit | AAK57544 | Q13765 | 1152 |
| *Homo sapiens* (human autoallergens) | Hom s 3 | No | BCD7B protein | CAA62012 | Q13845 | 1153 |
| *Homo sapiens* (human autoallergens) | Hom s 4 | No | Atopy related autoantigen CALC | CAA76830 | O75785 | 1154 |
| *Homo sapiens* (human autoallergens) | Hom s 5 | No | Keratin, type II cytoskeletal 6A | AAH69269 | P02538 | 1155 |
| *Lates calcarifer* (Barramundi) | Lat c 1.0101 | Yes | Beta 1-parvalbumin | AHW83198 | Q5IRB2 | 1156 |
| *Lates calcarifer* (Barramundi) | Lat c 1.0201 | Yes | Beta 2-parvalbumin | AAT45383 | Q6ITU9 | 1157 |
| *Lepidorhombus whiffiagonis* (Megrim, Whiff, Turbot fish) | Lep w 1 | Yes | Beta-parvalbumin | CAP17694 | B5WX08 | 1158 |
| *Mesocricetus auratus* (Golden hamster, Syrian hamster) | Mes a 1 | No | lipocalin | AAD55792 | Q9QXU1 | 1159 |
| *Mus musculus* (mouse) | Mus m 1.0101 | No | Lipocalin/urinary prealbumin 6 | CAA26953 | P02762 | 1160 |
| *Mus musculus* (mouse) | Mus m 1.0102 | No | Lipocalin/urinary prealbumin 2 | AAA39768 | P11589 | 1161 |
| *Oncorhynchus keta* (Chum salmon) | Onc k 5 | Yes | beta-prime-component of vitellogenin | BAJ07603 | D5MU14 | 1162 |
| *Oncorhynchus mykiss* (Rainbow trout) | Onc m 1.0101 | Yes | Beta1-parvalbumin | P86431 | P86431 | 1163 |
| *Oncorhynchus mykiss* (Rainbow trout) | Onc m 1.0201 | Yes | Beta2-parvalbumin | P86432 | P86432 | 1164 |
| *Oreochromis mossambicus* (Mozambique tilapia) | Ore m 4 | Yes | Tropomyosin | AFV53352 | K4PEK4 | 1165 |
| *Oryctolagus cuniculus* (rabbit) | Ory c 1 | No | Lipocalin | / | / | / |
| *Oryctolagus cuniculus* (rabbit) | Ory c 3.A.0101 | No | Lipophilin CL2 | AAG42806 | Q9GK63 | 1166 |

TABLE 5-continued

Allergen proteins

| Species | Allergen | Food Allergen | Biochemical name | GenBank | Uniprot | SEQ ID NO |
|---|---|---|---|---|---|---|
| *Oryctolagus cuniculus* (rabbit) | *Ory c* 3.B.0101 | No | Lipophilin AL | AAG42802 | Q9GK67 | 1167 |
| *Oryctolagus cuniculus* (rabbit) | *Ory c* 4 | No | Lipocalin | CCC15303 | U6C8D6 | 1168 |
| *Phodopus sungorus* (Siberian hamster) | *Phod s* 1 | No | Lipocalin | AGT28425 | S5ZYD3 | 1169 |
| *Rana esculenta* (edible frog) | *Ran e* 1 | Yes | Alpha-parvalbumin | CAC83046 | Q8JIU2 | 1170 |
| *Rana esculenta* (edible frog) | *Ran e* 2 | Yes | Beta-parvalbumin | CAC95152 | Q8JIU1 | 1171 |
| *Rastrelliger kanagurta* (Indian Mackerel) | *Ras k* 1 | Yes | Parvalbumin | ANW10058 | / | 1172 |
| *Rattus norvegicus* (Rat) | *Rat n* 1 | No | Alpha-2u-globulin/Lipocalin | AAA41198 | P02761 | 1173 |
| *Salmo salar* (Atlantic salmon) | *Sal s* 1 | Yes | Beta1-parvalbumin | CAA66403 | Q91482 | 1174 |
| *Salmo salar* (Atlantic salmon) | *Sal s* 2 | Yes | Beta-Enolase | ACH70932 | B5DGQ7 | 1175 |
| *Salmo salar* (Atlantic salmon) | *Sal s* 3 | Yes | Aldolase A | ACH70901 | B5DGM7 | 1176 |
| *Sardinops sagax* (Pacific pilchard) | *Sar sa* 1 | Yes | Beta-parvalbumin | CAQ68366 | B3WFF7 | 1177 |
| *Sebastes marinus* (Ocean perch, redfish, snapper) | *Seb m* 1.0101 | Yes | Beta-parvalbumin | CAQ72968 | C6GKU4 | 1178 |
| *Sebastes marinus* (Ocean perch, redfish, snapper) | *Seb m* 1.0201 | Yes | Beta-parvalbumin | CAQ72969 | C6GKU5 | 1179 |
| *Sus scrofa* (Domestic pig) | *Sus s* 1 | Yes | Serum albumin | AAA30988.1 | P08835 | 1180 |
| *Thunnus albacares* (Yellowfin tuna) | *Thu a* 1 | Yes | Beta-parvalbumin | CAQ72967 | C6GKU3 | 1181 |
| *Thunnus albacares* (Yellowfin tuna) | *Thu a* 2 | Yes | Beta-enolase | P86978 | P86978 | 1182 |
| *Thunnus albacares* (Yellowfin tuna) | *Thu a* 3 | Yes | Aldolase A | P86979 | P86979 | 1183 |
| *Xiphias gladius* (Swordfish) | *Xip g* 1 | Yes | Beta-parvalbumin | CAR48256 | B9W4C2 | 1184 |
| Animalia Cnidaria and Mollusca | | | | | | |
| *Dendronephthya* sp. (Soft Coral) | *Den n* 1 | No | / | / | / | / |
| *Crassostrea gigas* (Pacific Oyster) | *Cra g* 1.0101 | Yes | tropomyosin | ARX70262.1 | / | 1185 |
| *Crassostrea gigas* (Pacific Oyster) | *Cra g* 1.0102 | Yes | tropomyosin | BAH10152.1 | / | 1186 |
| *Haliotis laevigata* × *Haliotis rubra* (Jade tiger abaolone) | *Hal l* 1 | Yes | Tropomyosin | APG42675 | / | 1187 |
| *Haliotis midae* (Abalone) | *Hal m* 1 | Yes | / | / | / | / |
| *Helix aspersa* (Brown garden snail) | *Hel as* 1 | Yes | Tropomyosin | CAB3804 | O97192 | 1188 |
| *odes pacificus* (Japanese flying squid) | *Tod p* 1 | Yes | Tropomyosin | / | / | / |
| Animalia Nematoda | | | | | | |
| *Anisakis simplex* (Herring worm) | *Ani s* 1 | Yes | unknown function, similar to Kunitz serine protease inhibitors | BAC77154 | Q7Z1K3 | 1189 |
| *Anisakis simplex* (Herring worm) | *Ani s* 2 | Yes | Paramyosin | AAF72796 | Q9NJA9 | 1190 |
| *Anisakis simplex* (Herring worm) | *Ani s* 3 | Yes | Tropomyosin | CAB93501 | Q9NAS5 | 1191 |
| *Anisakis simplex* (Herring worm) | *Ani s* 4 | Yes | Cysteine protease inhibitor | CAK50389 | Q14QT4 | 1192 |
| *Anisakis simplex* (Herring worm) | *Ani s* 5 | Yes | SXP/RAL-2 family protein | BAF43534 | A1IKL2 | 1193 |
| *Anisakis simplex* (Herring worm) | *Ani s* 6 | Yes | Serine protease inhibitor | BAF43535 | A1IKL3 | 1194 |
| *Anisakis simplex* (Herring worm) | *Ani s* 7 | Yes | UA3-recognized allergen | ABL77410 | A9XBJ8 | 1195 |
| *Anisakis simplex* (Herring worm) | *Ani s* 8 | Yes | SXP/RAL-2 family protein, isoform 1 | BAF75681 | A7M6Q6 | 1196 |

TABLE 5-continued

Allergen proteins

| Species | Allergen | Food Allergen | Biochemical name | GenBank | Uniprot | SEQ ID NO |
|---|---|---|---|---|---|---|
| *Anisakis* simplex (Herring worm) | *Ani s* 9 | Yes | SXP/RAL-2 family protein | ABV55106 | B2XCP1 | 1197 |
| *Anisakis* simplex (Herring worm) | *Ani s* 10 | Yes | Protein with unknown function | ACZ95445 | D2K835 | 1198 |
| *Anisakis* simplex (Herring worm) | *Ani s* 11 | Yes | Protein with unknown function | BAJ78220 | E9RFF3 | 1199 |
| *Anisakis* simplex (Herring worm) | *Ani s* 12 | Yes | Protein with unknown function | BAJ78223 | E9RFF6 | 1200 |
| *Anisakis* simplex (Herring worm) | *Ani s* 13 | Yes | Hemoglobin | AFY98826 | K9USK2 | 1201 |
| *Anisakis* simplex (Herring worm) | *Ani s* 14 | Yes | 3rd stage larval protein unknown function | BAT62430 | A0A0S3Q267 | 1202 |
| *Ascaris lumbricoides* (Common roundworm) | *Asc l* 3 | No | Tropomyosin | ACN32322 | C0L3K2 | 1203 |
| *Ascaris lumbricoides* (Common roundworm) | *Asc l* 13 | No | lutathione S-transferase (GST) | P46436 | P46436 | 1204 |
| *Ascaris suum* (Pig roundworm) | *Asc s* 1 | No | Polyprotein ABA-1 | AAC06015 | Q06811 | 1205 |
| *Ascaris suum* (Pig roundworm) | *Asc s* 13 | No | Glutathione transferase | P46436 | P46436 | 1204 |
| Fungi Ascomycota | | | | | | |
| *Alternaria alternata* (*Alternaria* plant rot fungus) | *Alt a* 1.0101 | No | / (major allergen) | AAB47552 | P79085 | 1206 |
| *Alternaria alternata* (*Alternaria* plant rot fungus) | *Alt a* 1.0102 | No | / (major allergen) | AAS75297 | Q6Q128 | 1207 |
| *Alternaria alternata* (*Alternaria* plant rot fungus) | *Alt a* 3 | No | Heat shock protein 70 | AB48043 | P78983 | 1208 |
| *Alternaria alternata* (*Alternaria* plant rot fungus) | *Alt a* 4 | No | Disulfide isomerase | CAA58999 | Q00002 | 1209 |
| *Alternaria alternata* (*Alternaria* plant rot fungus) | *Alt a* 5 | No | Ribosomal protein P2 | AAB48041 | P42037 | 1210 |
| *Alternaria alternata* (*Alternaria* plant rot fungus) | *Alt a* 6 | No | Enolase | AAG42022 | Q9HDT3 | 1211 |
| *Alternaria alternata* (*Alternaria* plant rot fungus) | *Alt a* 7 | No | YCP4 protein | CAA55069 | P42058 | 1212 |
| *Alternaria alternata* (*Alternaria* plant rot fungus) | *Alt a* 8 | No | Mannitol dehydrogenase | AAO91800 | P0C0Y4 | 1213 |
| *Alternaria alternata* (*Alternaria* plant rot fungus) | *Alt a* 10 | No | Aldehyde dehydrogenase | CAA55071 | P42041 | 1214 |
| *Alternaria alternata* (*Alternaria* plant rot fungus) | *Alt a* 12 | No | Acid ribosomal protein P1 | CAA58998 | P49148 | 1215 |
| *Alternaria alternata* (*Alternaria* plant rot fungus) | *Alt a* 13 | No | Glutathione-S-transferase | AAR98813 | Q6R4B4 | 1216 |
| *Alternaria alternata* (*Alternaria* plant rot fungus) | *Alt a* 14 | No | Manganese superoxide dismutase | AGS80276 | P86254 | 1217 |
| *Alternaria alternata* (*Alternaria* plant rot fungus) | *Alt a* 15 | No | Serine protease | AHZ97469 | A0A0F6N3V8 | 1218 |
| *Aspergillus flavus* (Cereal mold) | *Asp fl* 13 | No | Alkaline serine protease | / | / | / |
| *Aspergillus fumigatus* (Common mold) | *Asp f* 1 | No | Mitogillin family | AAB07779 | P67875 | 1219 |
| *Aspergillus fumigatus* (Common mold) | *Asp f* 2 | No | / | AAC69357 | P79017 | 1220 |
| *Aspergillus fumigatus* (Common mold) | *Asp f* 3 | No | Peroxysomal protein | AAB95638 | O43099 | 1221 |
| *Aspergillus fumigatus* (Common mold) | *Asp f* 4 | No | / | CAA04959 | O60024 | 1222 |
| *Aspergillus fumigatus* (Common mold) | *Asp f* 5 | No | Extracellular metalloproteinase | CAA83015 | P46075 | 1223 |
| *Aspergillus fumigatus* (Common mold) | *Asp f* 6 | No | Mn superoxide dismutase | AAB60779 | Q92450 | 1224 |

TABLE 5-continued

Allergen proteins

| Species | Allergen | Food Allergen | Biochemical name | GenBank | Uniprot | SEQ ID NO |
|---|---|---|---|---|---|---|
| *Aspergillus fumigatus* (Common mold) | Asp f 7 | No | / | CAA11255 | O42799 | 1225 |
| *Aspergillus fumigatus* (Common mold) | Asp f 8 | No | Ribosomal protein P2 | CAB64688 | Q9UUZ6 | 1226 |
| *Aspergillus fumigatus* (Common mold) | Asp f 9 | No | / | CAA11266 | O42800 | 1227 |
| *Aspergillus fumigatus* (Common mold) | Asp f 10 | No | Aspartate protease | CAA59419 | Q12547 | 1228 |
| *Aspergillus fumigatus* (Common mold) | Asp f 11 | No | Peptidyl-prolyl isomerase | CAB44442 | Q9Y7F6 | 1229 |
| *Aspergillus fumigatus* (Common mold) | Asp f 12 | No | Heat shock protein P90 | AAB51544 | P40292 | 1230 |
| *Aspergillus fumigatus* (Common mold) | Asp f 13 | No | Alkaline serine protease | CAA77666 | P28296 | 1231 |
| *Aspergillus fumigatus* (Common mold) | Asp f 15 | No | / | CAA05149 | O60022 | 1232 |
| *Aspergillus fumigatus* (Common mold) | Asp f 16 | No | / | CAAC61261 | O74682 | 1233 |
| *Aspergillus fumigatus* (Common mold) | Asp f 17 | No | / | CAA12162 | O60025 | 1234 |
| *Aspergillus fumigatus* (Common mold) | Asp f 18 | No | Vacuolar serine protease | CAA73782 | P87184 | 1235 |
| *Aspergillus fumigatus* (Common mold) | Asp f 22 | No | Enolase | AAK49451 | Q96X30 | 1236 |
| *Aspergillus fumigatus* (Common mold) | Asp f 23 | No | L3 ribosomal protein | AAM43909 | Q8NKF4 | 1237 |
| *Aspergillus fumigatus* (Common mold) | Asp f 27 | No | Cyclophilin | CAI78448 | Q4WWX5 | 1238 |
| *Aspergillus fumigatus* (Common mold) | Asp f 28 | No | Thioredoxin | CAI78449 | Q1RQJ1 | 1239 |
| *Aspergillus fumigatus* (Common mold) | Asp f 29 | No | Thioredoxin | CAI78450 | Q4WV97 | 1240 |
| *Aspergillus fumigatus* (Common mold) | Asp f 34 | No | PhiA cell wall protein | CAM54066 | A4FSH5 | 1241 |
| *Aspergillus niger* (Black mold) | Asp n 14 | No | Beta-xylosidase | AD13106 | O93933 | 1242 |
| *Aspergillus niger* (Black mold) | Asp n 18 | No | Vacuolar serine protease | / | / | / |
| *Aspergillus niger* (Black mold) | Asp n 25 | No | 3-phytase B | AAA02934 | P34754 | 1243 |
| *Aspergillus oryzae* (Rice mold) | Asp o 13 | No | Alkaline serine protease | CAA35594 | P12547 | 1244 |
| *Aspergillus oryzae* (Rice mold) | Asp o 21 | No | TAKA-amylase A | BAA00336 | P10529 | 1245 |
| *Aspergillus versicolor* | Asp v 13 | No | Extracellular alkaline serine protease | ADE74975 | D5LGB3 | 1246 |
| *Candida albicans* (Common yeast) | Cand a 1 | No | Alcohol dehydrogenase | CAA57342 | P43067 | 1247 |
| *Candida albicans* (Common yeast) | Cand a 3 | No | Peroxysomal protein | AAN11300 | Q6YK78 | 1248 |
| *Candida boidinii* (Yeast) | Cand b 2 | No | Peroxisomal membrane protein A | AAA34357 | P14292 | 1249 |
| *Cladosporium cladosporioides* | Cla c 9 | No | Vacuolar serine protease | ABQ59329 | B0L807 | 1250 |
| *Cladosporium cladosporioides* | Cla c 14 | No | Transaldolase | ADK47394 | G8Z407 | 1251 |
| *Cladosporium herbarum* (Fungus of plants) | Cla h 2 | No | / | / | / | / |
| *Cladosporium herbarum* (Fungus of plants) | Cla h 5 | No | Acid ribosomal protein P2 | CAA55067 | P42039 | 1252 |
| *Cladosporium herbarum* (Fungus of plants) | Cla h 6 | No | Enolase | CAA55070 | P42040 | 1253 |
| *Cladosporium herbarum* (Fungus of plants) | Cla h 7 | No | YCP4 protein | CAA55068 | P42059 | 1254 |
| *Cladosporium herbarum* (Fungus of plants) | Cla h 8 | No | Mannitol dehydrogenase | AAO91801 | P0C0Y5 | 1255 |
| *Cladosporium herbarum* (Fungus of plants) | Cla h 9 | No | Vacuolar serine protease | AAX14379 | B7ZK61 | 1256 |

TABLE 5-continued

Allergen proteins

| Species | Allergen | Food Allergen | Biochemical name | GenBank | Uniprot | SEQ ID NO |
|---|---|---|---|---|---|---|
| *Cladosporium herbarum* (Fungus of plants) | *Cla h* 10 | No | Aldehyde dehydrogenase | CAA55072 | P40108 | 1257 |
| *Cladosporium herbarum* (Fungus of plants) | *Cla h* 12 | No | Acid ribosomal protein P1 | CAA59463 | P50344 | 1258 |
| *Curvularia lunata* (Synonym: *Cochliobolus lunatus*) | *Cur l* 1 | No | Serine protease | / | / | / |
| *Curvularia lunata* (Synonym: *Cochliobolus lunatus*) | *Cur l* 2 | No | Enolase | AAK67491 | Q96VP4 | 1259 |
| *Curvularia lunata* (Synonym: *Cochliobolus lunatus*) | *Cur l* 3 | No | Cytochrome c | AAK67492 | Q96VP3 | 1260 |
| *Curvularia lunata* (Synonym: *Cochliobolus lunatus*) | *Cur l* 4 | No | Vacuolar serine protease | ACF19589 | B3V0K8 | 1261 |
| *Epicoccum purpurascens* (Soil fungus) | *Epi p* 1 | No | Serine protease | P83340 | P83340 | 1262 |
| *Fusarium culmorum* (N.A.) | *Fus c* 1 | No | Ribosomal protein P2 | AAL79930 | Q8TFM9 | 1263 |
| *Fusarium culmorum* (N.A.) | *Fus c* 2 | No | Thioredoxin-like protein | AAL79931 | Q8TFM8 | 1264 |
| *Fusarium proliferatum* | *Fus p* 4 | No | Transaldolase | AHY02994 | / | 1265 |
| *Fusarium proliferatum* | *Fus p* 9 | No | Vacuolar serine protease | AJA79001 | A0A0U1Y1N5 | 1266 |
| *Penicillium brevicompactum* (Penicillin) | *Pen b* 13 | No | Alkaline serine protease | / | / | / |
| *Penicillium brevicompactum* (Penicillin) | *Pen b* 26 | No | Acidic ribosomal prot. P1 | AAX11194 | Q49KL9 | 1267 |
| *Penicillium chrysogenum* (Penicillin) | *Pen ch* 13 | No | Alkaline serine protease | AAF23726 | Q9URR2 | 1268 |
| *Penicillium chrysogenum* (Penicillin) | *Pen ch* 18 | No | Vacuolar serine protease | AAF71379 | Q9P8G3 | 1269 |
| *Penicillium chrysogenum* (Penicillin) | *Pen ch* 20 | No | N-acetyl-glucosaminidase | AAB34785 | Q02352 | 1270 |
| *Penicillium chrysogenum* (Penicillin) | *Pen ch* 31 | No | Calreticulin | AAX45072 | Q2TL59 | 1271 |
| *Penicillium chrysogenum* (Penicillin) | *Pen ch* 33 | No | / | ABP04053 | B0L0W9 | 1272 |
| *Penicillium chrysogenum* (Penicillin) | *Pen ch* 35 | No | Transaldolase | ADK27483 | G8Z408 | 1273 |
| *lium citrinum* (Penicillin) | *Pen c* 3 | No | Peroxysomal membrane protein | AAD42074 | Q9Y8B8 | 1274 |
| *lium citrinum* (Penicillin) | *Pen c* 13 | No | Alkaline serine protease (segment 1) | Q9URH1 | Q9URH1 | 1275 |
| *lium citrinum* (Penicillin) | *Pen c* 19 | No | Heat shock protein P70 | AAB06397 | Q92260 | 1276 |
| *lium citrinum* (Penicillin) | *Pen c* 22 | No | Enolase | AAK51201 | Q96X46 | 1277 |
| *lium citrinum* (Penicillin) | *Pen c* 24 | No | elongation factor 1 beta | AAR17475 | Q69BZ7 | 1278 |
| *lium citrinum* (Penicillin) | *Pen c* 30 | No | Catalase | ABB89950 | Q2V6Q5 | 1279 |
| *lium citrinum* (Penicillin) | *Pen c* 32 | No | Pectate lyase | ABM60783 | A2I7W3 | 1280 |
| *Penicillium crustosum* | *Pen cr* 26 | No | 60S acidic ribosomal phosphoprotein P1 | AEX34122 | H2E5X2 | 1281 |
| *Penicillium oxalicum* (Penicillin) | *Pen o* 18 | No | vacuolar serine protease | AAG44478 | Q9HF12 | 1282 |
| *Stachybotrys chartarum* | *Sta c* 3 | No | Extracellular alkaline Mg-dependent exodesoxyribonuclease | ACT37324 | C7E9W0 | 1283 |
| *Trichophyton rubrum* | *Tri r* 2 | No | Putative secreted alkaline protease Alp1 | AAD52013 | Q9UW97 | 1284 |

TABLE 5-continued

Allergen proteins

| Species | Allergen | Food Allergen | Biochemical name | GenBank | Uniprot | SEQ ID NO |
|---|---|---|---|---|---|---|
| *Trichophyton rubrum* | *Tri r* 4 | No | serine protease | AAD52012 | Q9UW98 | 1285 |
| *Trichophyton tonsurans* | *Tri t* 1 | No | / | / | / | / |
| *Trichophyton tonsurans* | *Tri t* 4 | No | Serine protease | P80514 | P80514 | 1286 |
| Fungi Basidiomycota and Zygomycota | | | | | | |
| *Coprinus comatus* (Shaggy mane) | *Cop c* 1 | No | Leucine zipper protein | CAB39376 | Q9Y7G3 | 1287 |
| *Coprinus comatus* (Shaggy mane) | *Cop c* 2 | No | Thioredoxin | CAB52130 | Q9UW02 | 1288 |
| *Coprinus comatus* (Shaggy mane) | *Cop c* 3 | No | / | CAB52131 | Q9UW01 | 1289 |
| *Coprinus comatus* (Shaggy mane) | *Cop c* 5 | No | / | CAB52132 | Q9UW00 | 1290 |
| *Coprinus comatus* (Shaggy mane) | *Cop c* 7 | No | / | CAB52133 | Q9UVZ9 | 1291 |
| *Malassezia furfur* (Pityriasis versicolor skin infection) | *Mala f* 2 | No | Peroxysomal membrane protein | BAA32435 | P56577 | 1292 |
| *Malassezia furfur* (Pityriasis versicolor skin infection) | *Mala f* 3 | No | Peroxysomal membrane protein | BAA32436 | P56578 | 1293 |
| *Malassezia furfur* (Pityriasis versicolor skin infection) | *Mala f* 4 | No | Mitochondrial malate dehydrogenase | AAD25927 | Q9Y750 | 1294 |
| *Malassezia sympodialis* (Skin fungus) | *Mala s* 1 | No | / | CAA65341 | Q01940 | 1295 |
| *Malassezia sympodialis* (Skin fungus) | *Mala s* 5 | No | / | CAA09883 | O93969 | 1296 |
| *Malassezia sympodialis* (Skin fungus) | *Mala s* 6 | No | Cyclophilin | CAA09884 | O93970 | 1297 |
| *Malassezia sympodialis* (Skin fungus) | *Mala s* 7 | No | / | CAA09885 | O93971 | 1298 |
| *Malassezia sympodialis* (Skin fungus) | *Mala s* 8 | No | / | CAA09886 | O93972 | 1299 |
| *Malassezia sympodialis* (Skin fungus) | *Mala s* 9 | No | / | CAA09887 | O93973 | 1300 |
| *Malassezia sympodialis* (Skin fungus) | *Mala s* 10 | No | heat shock protein 70 | CAD20981 | Q8TGH3 | 1301 |
| *Malassezia sympodialis* (Skin fungus) | *Mala s* 11 | No | manganese superoxide dismutase | CAD68071 | Q873M4 | 1302 |
| *Malassezia sympodialis* (Skin fungus) | *Mala s* 12 | No | glucose-methanol-choline (GMC) oxidoreductase | CAI43283 | Q5GMY3 | 1303 |
| *Malassezia sympodialis* (Skin fungus) | *Mala s* 13 | No | Thioredoxin | CAI78451 | Q1RQI9 | 1304 |
| *Psilocybe cubensis* (Magic mushroom) | *Psi c* 1 | No | / | / | / | / |
| *Psilocybe cubensis* (Magic mushroom) | *Psi c* 2 | No | Cyclophilin | / | / | / |
| *Rhodotorula mucilaginosa* (Yeast) | *Rho m* 1 | No | Enolase | AAP30720 | Q870B9 | 1305 |
| *Rhodotorula mucilaginosa* (Yeast) | *Rho m* 2 | No | vacuolar serine protease | AAT37679 | Q32ZM1 | 1306 |
| *Schizophyllum commune* | *Sch c* 1 | No | Glucoamylase | XP_003030591 | D8Q9M3 | 1307 |
| *Rhizopus oryzae* (Bread mold) | *Rhi o* 1 | No | Aspartyl endopeptidase | AIS82657 | I1CLC6 | 1308 |
| *Rhizopus oryzae* (Bread mold) | *Rhi o* 2 | No | Cyclophilin | ALM24136 | / | 1309 |
| Plantae Liliopsida | | | | | | |
| *Ananas comosus* (Pineapple) | *Ana c* 1 | Yes | Profilin | AAK54835 | Q94JN2 | 1310 |
| *Ananas comosus* (Pineapple) | *Ana c* 2 | Yes | Bromelain | BAA21849 | O23791 | 1311 |
| *Anthoxanthum odoratum* (Sweet vernal grass) | *Ant o* 1 | No | Beta-expansin | Q7M1X6 | Q7M1X6 | 1312 |
| *Asparagus officinalis* (Asparagus) | *Aspa o* 1 | Yes | Non-specific lipid transfer protein type 1 | / | / | / |
| *Cocos nucifera* (Coconut) | *Coc n* 1 | No | vicilin-like protein | ALQ56981.1 | / | 1313 |
| *Crocus sativus* (Saffron crocus) | *Cro s* 1 | No | / | AAX93750 | Q29W25 | 1314 |
| *Crocus sativus* (Saffron crocus) | *Cro s* 2 | No | Profilin | AAW81034 | Q5EF31 | 1315 |

TABLE 5-continued

Allergen proteins

| Species | Allergen | Food Allergen | Biochemical name | GenBank | Uniprot | SEQ ID NO |
|---|---|---|---|---|---|---|
| *Cynodon dactylon* (Bermuda grass) | *Cyn d* 1.0101 | No | Beta-expansin | AAB50734 | O04701 | 1316 |
| *Cynodon dactylon* (Bermuda grass) | *Cyn d* 1.0201 | No | Beta-expansin | AAK96255 | Q947S7 | 1317 |
| *Cynodon dactylon* (Bermuda grass) | *Cyn d* 10202 | No | Beta-expansin | AAL14077 | Q947S6 | 1318 |
| *Cynodon dactylon* (Bermuda grass) | *Cyn d* 1.0203 | No | Beta-expansin | AAL14079 | Q947S4 | 1319 |
| *Cynodon dactylon* (Bermuda grass) | *Cyn d* 1.0204 | No | Beta-expansin | AAF80379 | Q9FVM0 | 1320 |
| *Cynodon dactylon* (Bermuda grass) | *Cyn d* 7 | No | Polcalcin | CAA62634 | P94092 | 1321 |
| *Cynodon dactylon* (Bermuda grass) | *Cyn d* 12 | No | Profilin | CAA69670 | O04725 | 1322 |
| *Cynodon dactylon* (Bermuda grass) | *Cyn d* 15 | No | pollen allergen(/) | AAP80171 | Q7XYF2 | 1323 |
| *Cynodon dactylon* (Bermuda grass) | *Cyn d* 22w | No | enolase | / | / | / |
| *Cynodon dactylon* (Bermuda grass) | *Cyn d* 23 | No | / (pollen allergen) | AAP80170 | Q7XYF3 | 1324 |
| *Cynodon dactylon* (Bermuda grass) | *Cyn d* 24 | No | Pathogenesis-related protein PR-1 | AAU15051 | Q647J6 | 1325 |
| *Dactylis glomerata* (Orchard grass) | *Dac g* 1 | No | Beta-expansin | Q7M1X8 | Q7M1X8 | 1326 |
| *Dactylis glomerata* (Orchard grass) | *Dac g* 2 | No | / | AAB23303 | Q41183 | 1327 |
| *Dactylis glomerata* (Orchard grass) | *Dac g* 3 | No | / | AAB42200 | P93124 | 1328 |
| *Dactylis glomerata* (Orchard grass) | *Dac g* 4 | No | / | P82946 | P82946 | 1329 |
| *Dactylis glomerata* (Orchard grass) | *Dac g* 5 | No | / | / | / | / |
| *Festuca pratensis* (Meadow fescue) | *Fes p* 4 | No | / | / | / | / |
| *Holcus lanatus* (Velvet grass) | *Hol l* 1 | No | Beta-expansin | CAA81610 | P43216 | 1330 |
| *Holcus lanatus* (Velvet grass) | *Hol l* 5.0101 | No | Group V allergen | CAB10765 | O23972 | 1331 |
| *Holcus lanatus* (Velvet grass) | *Hol l* 5.0201 | No | Group V allergen | CAB10766 | O23971 | 1332 |
| *Hordeum vulgare* (Barley) | *Hor v* 5 | No | / | AAB41585 | O04828 | 1333 |
| *Hordeum vulgare* (Barley) | *Hor v* 12 | No | Profilin | AAA92503 | P52184 | 1334 |
| *Hordeum vulgare* (Barley) | *Hor v* 15 | No | Alpha-amylase inhibitor BMAI-1 precursor | CAA45085 | P16968 | 1335 |
| *Hordeum vulgare* (Barley) | *Hor v* 16 | No | Alpha-amylase | / | / | / |
| *Hordeum vulgare* (Barley) | *Hor v* 17 | No | Beta-amylase | / | / | / |
| *Hordeum vulgare* (Barley) | *Hor v* 20 | No | Gamma-hordein 3 | CAA51204 | P80198 | 1336 |
| *Lolium perenne* (Rye grass) | *Lol p* 1.0101 | No | Beta-expansin | AAA63279 | P14946 | 1337 |
| *Lolium perenne* (Rye grass) | *Lol p* 1.0103 | No | Beta-expansin | CAB63699 | Q9SC98 | 1338 |
| *Lolium perenne* (Rye grass) | *Lol p* 2 | No | / | P14947 | P14947 | 1339 |
| *Lolium perenne* (Rye grass) | *Lol p* 3 | No | / | P14948 | P14948 | 1340 |
| *Lolium perenne* (Rye grass) | *Lol p* 4 | No | / | CAH92637 | Q5TIW3 | 1341 |
| *Lolium perenne* (Rye grass) | *Lol p* 5 | No | / | AAA33405 | Q40237 | 1342 |
| *Lolium perenne* (Rye grass) | *Lol p* 11 | No | Ole e 1-related protein | Q7M1X5 | Q7M1X5 | 1343 |
| *Musa acuminata* (Banana) | *Mus a* 1 | Yes | Profilin | AAK54834 | Q94JN3 | 1344 |
| *Musa acuminata* (Banana) | *Mus a* 2 | Yes | Class 1 chitinase | CAC81811 | Q8VXF1 | 1345 |
| *Musa acuminata* (Banana) | *Mus a* 3 | Yes | Non-specific lipid transfer protein type 1 (nsLTP1) | P86333 | P86333 | 1346 |
| *Musa acuminata* (Banana) | *Mus a* 4 | Yes | Thaumatin-like protein (Chain A) | 1Z3Q_A | / | 1347 |

TABLE 5-continued

Allergen proteins

| Species | Allergen | Food Allergen | Biochemical name | GenBank | Uniprot | SEQ ID NO |
|---|---|---|---|---|---|---|
| *Musa acuminata* (Banana) | *Mus a* 5 | Yes | Beta-1,3-glucanase | / | / | / |
| *Musa acuminata* (Banana) | *Mus a* 6 | Yes | ascorbate peroxidase | / | / | / |
| *Oryza sativa* (Rice) | *Ory s* 1 | No | Beta-expansin | AAA86533 | Q40638 | 1348 |
| *Oryza sativa* (Rice) | *Ory s* 12 | Yes | Profilin A | AAG32056 | Q9FUD1 | 1349 |
| *Paspalum notatum* (Bahia grass) | *Pas n* 1 | No | Beta expansin | ACA23876 | B8PYF3 | 1350 |
| *Phalaris aquatica* (Canary grass) | *Pha a* 1 | No | Beta-expansin | AAB35984 | Q41260 | 1351 |
| *Phalaris aquatica* (Canary grass) | *Pha a* 5 | No | / | P56164 | P56164 | 1352 |
| *Phleum pratense* (Timothy) | *Phl p* 1.0101 | No | Beta-expansin | CAA81613 | Q40967 | 1353 |
| *Phleum pratense* (Timothy) | *Phl p* 1.0102 | No | Beta-expansin | CAA55390 | P43213 | 1354 |
| *Phleum pratense* (Timothy) | *Phl p* 2 | No | Grass group II/III | CAA53529 | P43214 | 1355 |
| *Phleum pratense* (Timothy) | *Phl p* 4.0101 | No | Berberine bridge enzyme | CAD54670 | Q5ZQK5 | 1356 |
| *Phleum pratense* (Timothy) | *Phl p* 4.0201 | No | Berberine bridge enzyme | CAD54671 | Q5ZQK4 | 1357 |
| *Phleum pratense* (Timothy) | *Phl p* 5.0101 | No | / | CAA52753 | Q40960 | 1358 |
| *Phleum pratense* (Timothy) | *Phl p* 5.0102 | No | / | CAA50281 | Q40962 | 1359 |
| *Phleum pratense* (Timothy) | *Phl p* 5.0103 | No | / | AAC25994 | O81341 | 1360 |
| *Phleum pratense* (Timothy) | *Phl p* 5.0104 | No | / | CAB05372 | P93467 | 1361 |
| *Phleum pratense* (Timothy) | *Phl p* 5.0105 | No | / | AAC16525 | O65318 | 1362 |
| *Phleum pratense* (Timothy) | *Phl p* 5.0106 | No | / | AAC16526 | O65319 | 1363 |
| *Phleum pratense* (Timothy) | *Phl p* 5.0108 | No | / | AAC16528 | O65321 | 1364 |
| *Phleum pratense* (Timothy) | *Phl p* 5.0109 | No | / | CAD87529 | Q84UI2 | 1365 |
| *Phleum pratense* (Timothy) | *Phl p* 5.0201 | No | / | CAA81609 | Q40963 | 1366 |
| *Phleum pratense* (Timothy) | *Phl p* 5.0202 | No | / | CAB05371 | P93466 | 1367 |
| *Phleum pratense* (Timothy) | *Phl p* 5.0203 | No | / | AAC25995 | O81342 | 1368 |
| *Phleum pratense* (Timothy) | *Phl p* 5.0206 | No | / | AAC25997 | O81343 | 1369 |
| *Phleum pratense* (Timothy) | *Phl p* 5.0207 | No | / | AAC25998 | O81344 | 1370 |
| *Phleum pratense* (Timothy) | *Phl p* 6.0101 | No | / | CAA81608 | P43215 | 1371 |
| *Phleum pratense* (Timothy) | *Phl p* 6.0102 | No | / | CAA76556 | O65868 | 1372 |
| *Phleum pratense* (Timothy) | *Phl p* 7 | No | Polcalcin | CAA76887 | O82040 | 1373 |
| *Phleum pratense* (Timothy) | *Phl p* 11 | No | Ole e 1-related protein | AAN32987 | Q8H6L7 | 1374 |
| *Phleum pratense* (Timothy) | *Phl p* 12.0101 | No | Profilin-1 | CAA54686 | P35079 | 1375 |
| *Phleum pratense* (Timothy) | *Phl p* 12.0102 | No | Profilin-2 | CAA70608 | O24650 | 1376 |
| *Phleum pratense* (Timothy) | *Phl p* 12.0103 | No | Profilin-3 | CAA70609 | O24282 | 1377 |
| *Phleum pratense* (Timothy) | *Phl p* 13 | No | Polygalacturonase | CAB42886 | Q9XG86 | 1378 |
| *Phoenix dactylifera* (Date palm) | *Pho d* 2 | No | Profilin | CAD10390 | Q8L5D8 | 1379 |
| *Poa pratensis* (Kentucky blue grass) | *Poa p* 1 | No | Beta-expansin | CAA10520 | Q9ZP03 | 1380 |
| *Poa pratensis* (Kentucky blue grass) | *Poa p* 5 | No | / (pollen allergen) | AAG42254 | Q9FPR0 | 1381 |
| *Secale cereale* (Rye) | *Sec c* 5 | No | Group 5 grass pollen allergen | CBG76811 | F4MJM3 | 1382 |

TABLE 5-continued

Allergen proteins

| Species | Allergen | Food Allergen | Biochemical name | GenBank | Uniprot | SEQ ID NO |
|---|---|---|---|---|---|---|
| *Secale cereale* (Rye) | Sec c 20.0101 | Yes | Gamma-70 SECALIN isoform S10-12 (COELIAC immunoreactive protein) | Q9S8B0 | Q9S8B0 | 1383 |
| *Secale cereale* (Rye) | Sec c 20.0201 | Yes | Gamma-35 SECALIN isoform P13-14 (COELIAC immunoreactive protein) | Q9S8A7 | Q9S8A7 | 1384 |
| *Secale cereale* (Rye) | Sec c 38 | No | Dimeric alpha-amylase/trypsin inhibitor | Q9S8H2 | Q9S8H2 | 1385 |
| *Sorghum halepense* (Johnson grass) | Sor h 1.0101 | No | Beta-expansin | AIL01316 | C5WMS3 | 1386 |
| *Sorghum halepense* (Johnson grass) | Sor h 1.0201 | No | Beta-expansin | AIL01317 | A0A077B4J2 | 1387 |
| *Sorghum halepense* (Johnson grass) | Sor h 2.0101 | No | Expansin-like protein; grass pollen group 2 allergen | AIL01318 | A0A077B7S9 | 1388 |
| *Sorghum halepense* (Johnson grass) | Sor h 2.0201 | No | Expansin-like protein; grass pollen group 2 allergen | AIL01319 | A0A077B2S0 | 1389 |
| *Sorghum halepense* (Johnson grass) | Sor h 13.0101 | No | Exopolygalacturonase (Glycosyl hydrolase 28) | AIL01320 | A0A077B155 | 1390 |
| *Sorghum halepense* (Johnson grass) | Sor h 13.0201 | No | Exopolygalacturonase (Glycosyl hydrolase 28) | AIL01321 | A0A077B569 | 1391 |
| *Triticum aestivum* (Wheat) | Tri a 12.0101 | No | Profilin-1 | CAA61943 | P49232 | 1392 |
| *Triticum aestivum* (Wheat) | Tri a 12.0102 | No | Profilin-2 | CAA61944 | P49233 | 1393 |
| *Triticum aestivum* (Wheat) | Tri a 12.0103 | No | Profilin-3 | CAA61945 | P49234 | 1394 |
| *Triticum aestivum* (Wheat) | Tri a 12.0104 | No | Profilin-4 | CAQ57979 | B6EF35 | 1395 |
| *Triticum aestivum* (Wheat) | Tri a 14 | Yes | Non-specific lipid transfer protein 1 | CAY54133 | D2T2K2 | 1396 |
| *Triticum aestivum* (Wheat) | Tri a 15 | No | Monomeric alpha-amylase inhibitor 0.28 | CBA13560 | D2TGC3 | 1397 |
| *Triticum aestivum* (Wheat) | Tri a 18 | Yes | Agglutinin isolectin 1 | AAA34256 | P10968 | 1398 |
| *Triticum aestivum* (Wheat) | Tri a 19 | Yes | Omega-5 gliadin, seed storage protein | BAE20328 | Q402I5 | 1399 |
| *Triticum aestivum* (Wheat) | Tri a 20 | Yes | Gamma gliadin | BAN29066 | Q9SYX8 | 1400 |
| *Triticum aestivum* (Wheat) | Tri a 21 | No | alpha-beta-gliadin | CAY54134 | D2T2K3 | 1401 |
| *Triticum aestivum* (Wheat) | Tri a 25 | Yes | Thioredoxin H | CAB96931 | Q9LDX4 | 1402 |
| *Triticum aestivum* (Wheat) | Tri a 26.0101 | Yes | High molecular weight glutenin subunit Dx5 | CAA31395 | P10388 | 1403 |
| *Triticum aestivum* (Wheat) | Tri a 26.0201 | Yes | High molecular weight glutenin subunit Bx7 | AAZ23584 | Q45R38 | 1404 |
| *Triticum aestivum* (Wheat) | Tri a 27 | No | Thiol reductase homologue | BAC76688 | Q7Y1Z2 | 1405 |
| *Triticum aestivum* (Wheat) | Tri a 28 | No | Dimeric alpha-amylase inhibitor 0.19 | CAI84642 | Q4W0V7 | 1406 |
| *Triticum aestivum* (Wheat) | Tri a 29.0101 | No | Tetrameric alpha-amylase inhibitor CM1 | CAZ76052 | C7C4X0 | 1407 |
| *Triticum aestivum* (Wheat) | Tri a 29.0201 | No | Tetrameric alpha-amylase inhibitor CM2 | CBA13559 | D2TGC2 | 1408 |
| *Triticum aestivum* (Wheat) | Tri a 30 | No | Tetrameric alpha-amylase inhibitor CM3 | CAA35597 | P17314 | 1409 |
| *Triticum aestivum* (Wheat) | Tri a 31 | No | Triosephosphate-isomerase | CAC14917 | Q9FS79 | 1410 |
| *Triticum aestivum* (Wheat) | Tri a 32 | No | 1-cys-peroxiredoxin | AAQ74769 | Q6W8Q2 | 1411 |
| *Triticum aestivum* (Wheat) | Tri a 33 | No | Serpin | CAB52710 | Q9ST57 | 1412 |
| *Triticum aestivum* (Wheat) | Tri a 34 | No | Glyceraldehyde-3-phosphate-dehydrogenase | CAZ76054 | C7C4X1 | 1413 |
| *Triticum aestivum* (Wheat) | Tri a 35 | No | Dehydrin | CAY85463 | D2TE72 | 1414 |
| *Triticum aestivum* (Wheat) | Tri a 36 | Yes | Low molecular weight glutenin GluB3-23 | AEH31546 | B2Y2Q7 | 1415 |
| *Triticum aestivum* (Wheat) | Tri a 37 | Yes | Alpha purothionin | CAA65313 | Q9T0P1 | 1416 |

TABLE 5-continued

Allergen proteins

| Species | Allergen | Food Allergen | Biochemical name | GenBank | Uniprot | SEQ ID NO |
|---|---|---|---|---|---|---|
| *Triticum aestivum* (Wheat) | *Tri a* 39 | No | Serine protease inhibitor-like protein | CCK33471 | J7QW61 | 1417 |
| *Triticum aestivum* (Wheat) | *Tri a* 40 | No | oform/methanol-soluble (CM) 17 protein [alpha amylase inhibitor] | CAA42453.1 | Q41540 | 1418 |
| *Triticum aestivum* (Wheat) | *Tri a* 41 | Yes | Mitochondrial ubiquitin ligase activator of NFKB 1 | AKJ77988.1 | A0A0G3F2P1 | 1419 |
| *Triticum aestivum* (Wheat) | *Tri a* 42 | Yes | Hypothetical protein from cDNA | AKJ77986.1 | A0A0G3F2F5 | 1420 |
| *Triticum aestivum* (Wheat) | *Tri a* 43 | Yes | Hypothetical protein from cDNA | AKJ77987.1 | A0A0G3F5F7 | 1421 |
| *Triticum aestivum* (Wheat) | *Tri a* 44 | Yes | Endosperm transfer cell specific PR60 precursor | AKJ77990.1 | A0A0G3F720 | 1422 |
| *Triticum aestivum* (Wheat) | *Tri a* 45 | Yes | Elongation factor 1 (EIF1) | AKJ77985.1 | A0A0G3F715 | 1423 |
| *Zea mays* (Maize) | *Zea m* 1 | No | Beta-expansin | AAA33496 | Q07154 | 1424 |
| *Zea mays* (Maize) | *Zea m* 8 | Yes | Chitinase | ACX37090 | P29022 | 1425 |
| *Zea mays* (Maize) | *Zea m* 12.0101 | No | Profilin-1 | CAA51718 | P35081 | 1426 |
| *Zea mays* (Maize) | *Zea m* 12.0102 | No | Profilin-2 | CAA51719 | P35082 | 1427 |
| *Zea mays* (Maize) | *Zea m* 12.0103 | No | Profilin-3 | CAA51720 | P35083 | 1428 |
| *Zea mays* (Maize) | *Zea m* 12.0104 | No | Profilin-4 | AAB86960 | O22655 | 1429 |
| *Zea mays* (Maize) | *Zea m* 12.0105 | No | Profilin-5 | AAG35601 | Q9FR39 | 1430 |
| *Zea mays* (Maize) | *Zea m* 14.0101 | Yes | Non-specific lipid-transfer protein, isoform 1 | AAA33493 | P19656-1 | 1431 |
| *Zea mays* (Maize) | *Zea m* 14.0102 | Yes | Non-specific lipid-transfer protein, isoform 2 | AAA33494 | P19656-2 | 1432 |
| *Zea mays* (Maize) | *Zea m* 25 | No | thioredoxin | CAI64400 | Q4W1F7 | 1433 |
| Plantae Magnoliopsida | | | | | | |
| *Acacia farnesiana* (*Vachellia farnesiana*) (Needle bush) | *Aca f* 1 | No | Ole e 1-like protein | AKV7266.1 | A0A0K1SC24 | 1434 |
| *Acacia farnesiana* (*Vachellia farnesiana*) (Needle bush) | *Aca f* 2 | No | profilin | AIV43662.1 | A0A0A0RCW1 | 1435 |
| *Actinidia chinensis* (Gold Kiwi fruit) | *Act c* 5.0101 | Yes | Kiwellin | P85261.1 | P85261 | 1436 |
| *Actinidia chinensis* (Gold Kiwi fruit) | *Act c* 5.0102 | Yes | Kiwellin | AGC39168.1 | L7TT83 | 1437 |
| *Actinidia chinensis* (Gold Kiwi fruit) | *Act c* 8 | Yes | Pathogenesis-related protein, PR-10, *Bet v* 1 family member | CAM31908.1 | D1YSM4 | 1438 |
| *Actinidia chinensis* (Gold Kiwi fruit) | *Act c* 10 | Yes | Non-specific lipid-transfer protein 1 | P85204 | P85204 | 1439 |
| *Actinidia deliciosa* (Green Kiwi fruit) | *Act d* 1 | Yes | Cysteine protease (actinidin) | CAA34486 | P00785 | 1440 |
| *Actinidia deliciosa* (Green Kiwi fruit) | *Act d* 2 | Yes | Thaumatin-like protein | CAI38795 | P81370 | 1441 |
| *Actinidia deliciosa* (Green Kiwi fruit) | *Act d* 3 | Yes | / | P85063 | P85063 | 1442 |
| *Actinidia deliciosa* (Green Kiwi fruit) | *Act d* 4 | Yes | Phytocystatin | AAR92223 | Q6TPK4 | 1443 |
| *Actinidia deliciosa* (Green Kiwi fruit) | *Act d* 5 | Yes | Kiwellin | P84527 | P84527 | 1444 |
| *Actinidia deliciosa* (Green Kiwi fruit) | *Act d* 6 | Yes | Pectin methylesterase inhibitor | BAC54964 | P83326 | 1445 |
| *Actinidia deliciosa* (Green Kiwi fruit) | *Act d* 7 | Yes | Pectin methylesterase | P85076 | P85076 | 1446 |
| *Actinidia deliciosa* (Green Kiwi fruit) | *Act d* 8 | Yes | Pathogenesis-related protein, PR-10, *Bet v* 1 family member | CAM31909 | D1YSM5 | 1447 |
| *Actinidia deliciosa* (Green Kiwi fruit) | *Act d* 9 | Yes | Profilin | / | / | / |
| *Actinidia deliciosa* (Green Kiwi fruit) | *Act d* 10.0101 | Yes | Non-specific lipid-transfer protein 1 | P86137 | P86137 | 1448 |
| *Actinidia deliciosa* (Green Kiwi fruit) | *Act d* 10.0201 | Yes | Non-specific lipid-transfer protein 2 | P85206 | P85206 | 1449 |

TABLE 5-continued

Allergen proteins

| Species | Allergen | Food Allergen | Biochemical name | GenBank | Uniprot | SEQ ID NO |
|---|---|---|---|---|---|---|
| *Actinidia deliciosa* (Green Kiwi fruit) | Act d 11 | Yes | Major latex protein/ripening-related protein (MLP/RRP), *Bet v* 1 family member | P85524 | P85524 | 1450 |
| *Actinidia deliciosa* (Green Kiwi fruit) | Act d 12.0101 | Yes | Cupin, 11S globulin | / | C0HJF9.1 | 1451 |
| *Actinidia deliciosa* (Green Kiwi fruit) | Act d 12.0102 | Yes | Cupin, 11S globulin | ABB77213 | / | 1452 |
| *Actinidia deliciosa* (Green Kiwi fruit) | Act d 13 | Yes | 2S albumin | / | / | / |
| *Alnus glutinosa* (Alder) | Aln g 1 | No | Pathogenesis-related protein, PR-10, *Bet v* 1 family member | AAB24432 | P38948 | 1453 |
| *Alnus glutinosa* (Alder) | Aln g 4 | No | Polcalcin | CAA76831 | O81701 | 1454 |
| *Amaranthus retroflexus* (Redroot pigweed) | Ama r 1 | No | Ole e 1- like protein | AKV72168 | A0A0K1SC10 | 1455 |
| *Amaranthus retroflexus* (Redroot pigweed) | Ama r 2 | No | Profilin | ACP43298 | C3W2Q7 | 1456 |
| *Ambrosia artemisiifolia* (Short ragweed) | Amb a 1.0101 | No | Pectate lyase 5 | AAA32665 | P27759 | 1457 |
| *Ambrosia artemisiifolia* (Short ragweed) | Amb a 1.0201 | No | Pectate lyase 1 | AAA32666 | P27760 | 1458 |
| *Ambrosia artemisiifolia* (Short ragweed) | Amb a 1.0202 | No | Pectate lyase | CBW30987 | E1XUL3 | 1459 |
| *Ambrosia artemisiifolia* (Short ragweed) | Amb a 1.0301 | No | Pectate lyase 2 | AAA32668 | P27761 | 1460 |
| *Ambrosia artemisiifolia* (Short ragweed) | Amb a 1.0302 | No | Pectate lyase 2 | / | P27761 (variant L48Y) | 1460 |
| *Ambrosia artemisiifolia* (Short ragweed) | Amb a 1.0303 | No | Pectate lyase 2 | AAA32669 | P27761 (variant H392R) | 1460 |
| *Ambrosia artemisiifolia* (Short ragweed) | Amb a 1.0304 | No | Pectate lyase | CBW30988 | E1XUL4 | 1461 |
| *Ambrosia artemisiifolia* (Short ragweed) | Amb a 1.0305 | No | Pectate lyase | CBW30989 | E1XUL5 | 1462 |
| *Ambrosia artemisiifolia* (Short ragweed) | Amb a 1.0401 | No | Pectate lyase 3 | AAA32670 | P28744 | 1463 |
| *Ambrosia artemisiifolia* (Short ragweed) | Amb a 1.0402 | No | Pectate lyase | CBW30993 | E1XUL9 | 1464 |
| *Ambrosia artemisiifolia* (Short ragweed) | Amb a 1.0501 | No | Pectate lyase 4 | AAA32671 | P27762 | 1465 |
| *Ambrosia artemisiifolia* (Short ragweed) | Amb a 1.0502 | No | Pectate lyase | CBW30995 | E1XUM1 | 1466 |
| *Ambrosia artemisiifolia* (Short ragweed) | Amb a 3 | No | Plastocyanine | P00304 | P00304 | 1467 |
| *Ambrosia artemisiifolia* (Short ragweed) | Amb a 4 | No | Defensin-like protein | CBK52317 | D4IHC0 | 1468 |
| *Ambrosia artemisiifolia* (Short ragweed) | Amb a 5 | No | / | P02878 | P02878 | 1469 |
| *Ambrosia artemisiifolia* (Short ragweed) | Amb a 6 | No | Non-specific lipid transfer protein type 1 | AAB51146 | O04004 | 1470 |
| *Ambrosia artemisiifolia* (Short ragweed) | Amb a 7 | No | Plastocyanin | / | / | / |
| *Ambrosia artemisiifolia* (Short ragweed) | Amb a 8.0101 | No | Profilin | AAX77687 | Q2KN24 | 1471 |
| *Ambrosia artemisiifolia* (Short ragweed) | Amb a 8.0102 | No | Profilin | AAX77688 | Q2KN23 | 1472 |
| *Ambrosia artemisiifolia* (Short ragweed) | Amb a 9.0101 | No | Polcalcin 9Calcium-binding protein isoallergen 1) | AAX77684 | Q2KN27 | 1473 |
| *Ambrosia artemisiifolia* (Short ragweed) | Amb a 9.0102 | No | Calcium-binding protein isoallergen 2 | AAX77685 | Q2KN26 | 1474 |
| *Ambrosia artemisiifolia* (Short ragweed) | Amb a 10 | No | Polcalcin-like protein (4 EF-hands) | AAX77686 | Q2KN25 | 1475 |
| *Ambrosia artemisiifolia* (Short ragweed) | Amb a 11 | No | Cysteine protease | AHA56102 | V5LU01 | 1476 |
| *Ambrosia artemisiifolia* (Short ragweed) | Amb a 12.0101 | No | Enolase | ANZ22901.1 | A0A1B2H9Q1 | 1477 |
| *Ambrosia artemisiifolia* (Short ragweed) | Amb a 12.0102 | No | Enolase | ANZ22900 | A0A1B2H9Q5 | 1478 |
| *Ambrosia psilostachya* (Western ragweed) | Amb p 5.0101 | No | / (pollen allergen) | AAA20065 | P43174 | 1479 |
| *Ambrosia psilostachya* (Western ragweed) | Amb p 5.0201 | No | / (pollen Allergen) | AAA20064 | P43175 | 1480 |

TABLE 5-continued

Allergen proteins

| Species | Allergen | Food Allergen | Biochemical name | GenBank | Uniprot | SEQ ID NO |
|---|---|---|---|---|---|---|
| *Ambrosia trifida* (Giant ragweed) | *Amb t* 5 | No | / (pollen allergen) | CAA39726 | P10414 | 1481 |
| *Anacardium occidentale* (Cashew) | *Ana o* 1.0101 | Yes | Vicilin-like protein | AAM73730 | Q8L5L5 | 1482 |
| *Anacardium occidentale* (Cashew) | *Ana o* 1.0102 | Yes | Vicilin-like protein | AAM73729 | Q8L5L6 | 1483 |
| *Anacardium occidentale* (Cashew) | *Ana o* 2 | Yes | Legumin-like protein | AAN76862 | Q8GZP6 | 1484 |
| *Anacardium occidentale* (Cashew) | *Ana o* 3 | Yes | 2s albumin | AAL91665 | Q8H2B8 | 1485 |
| *Apium graveolens* (Celery) | *Api g* 1.0101 | Yes | Pathogenesis-related protein, PR-10, *Bet v* 1 family member, isoallergen 1 | CAA88831 | P49372 | 1486 |
| *Apium graveolens* (Celery) | *Api g* 1.0201 | Yes | Pathogenesis-related protein, PR-10, *Bet v* 1 family member, isoallergen 2 | CAA99992 | P92918 | 1487 |
| *Apium graveolens* (Celery) | *Api g* 2 | Yes | Non-specific lipid-transfer protein, type 1 | ACV04796 | E6Y8S8 | 1488 |
| *Apium graveolens* (Celery) | *Api g* 3 | Yes | Chlorophyll a-b binding protein, chloroplast | CAA99993 | P92919 | 1489 |
| *Apium graveolens* (Celery) | *Api g* 4 | Yes | Profilin | AAD29409 | Q9XF37 | 1490 |
| *Apium graveolens* (Celery) | *Api g* 5 | Yes | FAD-containing oxidase | P81943 | P81943 | 1491 |
| *Apium graveolens* (Celery) | *Api g* 6 | Yes | Non-specific lipid transfer protein type 2 | P86809 | P86809 | 1492 |
| *Arachis hypogaea* (Peanut, groundnut) | *Ara h* 1 | Yes | Cupin (Vicillin-type, 7S globulin) | AAB00861 | P43238 | 1493 |
| *Arachis hypogaea* (Peanut, groundnut) | *Ara h* 2 | Yes | Conglutin-7 (2S albumin), isoform 1 | AAK96887 | Q6PSU2 | 1494 |
| *Arachis hypogaea* (Peanut, groundnut) | *Ara h* 3.0101 | Yes | Cupin (Legumin-type, 11S globulin, Glycinin) | AAC63045 | O82580 | 1495 |
| *Arachis hypogaea* (Peanut, groundnut) | *Ara h* 3.0201 | Yes | Cupin (Legumin-type, 11S globulin, Glycinin) | AAD47382 | Q9SQH7 | 1496 |
| *Arachis hypogaea* (Peanut, groundnut) | *Ara h* 5 | Yes | Profilin | AAD55587 | Q9SQI9 | 1497 |
| *Arachis hypogaea* (Peanut, groundnut) | *Ara h* 6 | Yes | Conglutin (2S albumin) | AAD56337 | Q647G9 | 1498 |
| *Arachis hypogaea* (Peanut, groundnut) | *Ara h* 7.0101 | Yes | Conglutin (2S albumin) | AAD56719 | Q9SQH1 | 1499 |
| *Arachis hypogaea* (Peanut, groundnut) | *Ara h* 7.0201 | Yes | Conglutin (2S albumin) | ABW17159 | B4XID4 | 1500 |
| *Arachis hypogaea* (Peanut, groundnut) | *Ara h* 8.0101 | Yes | Pathogenesis-related protein, PR-10, *Bet v* 1 family member | AAQ91847 | Q6VT83 | 1501 |
| *Arachis hypogaea* (Peanut, groundnut) | *Ara h* 8.0201 | Yes | Pathogenesis-related protein, PR-10, *Bet v* 1 family member | ABP97433 | B0YIU5 | 1502 |
| *Arachis hypogaea* (Peanut, groundnut) | *Ara h* 9.0101 | Yes | Nonspecific lipid-transfer protein type 1 | ABX56711 | B6CEX8 | 1503 |
| *Arachis hypogaea* (Peanut, groundnut) | *Ara h* 9.0201 | Yes | Nonspecific lipid-transfer protein type 1 | ABX75045 | B6CG41 | 1504 |
| *Arachis hypogaea* (Peanut, groundnut) | *Ara h* 10.0101 | Yes | 16 kDa oleosin-1 | AAU21499 | Q647G5 | 1505 |
| *Arachis hypogaea* (Peanut, groundnut) | *Ara h* 10.0102 | Yes | 16 kDa oleosin-2 | AAU21500 | Q647G4 | 1506 |
| *Arachis hypogaea* (Peanut, groundnut) | *Ara h* 11.0101 | Yes | 14 kDa oleosin-1 | AAZ20276 | Q45W87 | 1507 |
| *Arachis hypogaea* (Peanut, groundnut) | *Ara h* 11.0102 | Yes | 14 kDa oleosin-2 | AAZ20277 | Q45W86 | 1508 |
| *Arachis hypogaea* (Peanut, groundnut) | *Ara h* 12 | Yes | Defensin | / | / | / |
| *Arachis hypogaea* (Peanut, groundnut) | *Ara h* 13 | Yes | Defensin | / | / | / |
| *Arachis hypogaea* (Peanut, groundnut) | *Ara h* 14.0101 | Yes | Oleosin, variant A | AAK13449 | Q9AXI1 | 1509 |
| *Arachis hypogaea* (Peanut, groundnut) | *Ara h* 14.0102 | Yes | Oleosin, variant B | AAK13450 | Q9AXI0 | 1510 |
| *Arachis hypogaea* (Peanut, groundnut) | *Ara h* 14.0103 | Yes | Oleosin | AAT11925 | Q6J1J8 | 1511 |
| *Arachis hypogaea* (Peanut, groundnut) | *Ara h* 15 | Yes | Oleosin | AAU21501 | Q647G3 | 1512 |
| *Arachis hypogaea* | *Ara h* 16 | Yes | non-specific Lipid Transfer | / | / | / |

TABLE 5-continued

Allergen proteins

| Species | Allergen | Food Allergen | Biochemical name | GenBank | Uniprot | SEQ ID NO |
|---|---|---|---|---|---|---|
| *Arachis hypogaea* (Peanut, groundnut) | *Ara h* 17 | Yes | non-specific Lipid Transfer Protein 1 | / | / | / |
| *Artemisia annua* (Sweet Wormwood) | *Art an* 7 | No | Galactose oxidase | / | / | / |
| *Artemisia vulgaris* (Mugwort, wormwood) | *Art v* 1 | No | Defensin-like protein | AAO24900 | Q84ZX5 | 1513 |
| *Artemisia vulgaris* (Mugwort, wormwood) | *Art v* 2 | No | Pathogenesis-related protein PR-1 | CAK50834 | A6GVD5 | 1514 |
| *Artemisia vulgaris* (Mugwort, wormwood) | *Art v* 3.0101 | No | Nonspecific lipid transfer protein type 1 | P0C088 | P0C088 | 1515 |
| *Artemisia vulgaris* (Mugwort, wormwood) | *Art v* 3.0201 | No | Nonspecific lipid transfer protein type 1 | ACE07186 | C4MGG9 | 1516 |
| *Artemisia vulgaris* (Mugwort, wormwood) | *Art v* 3.0202 | No | Nonspecific lipid transfer protein type 1 | ACE07187 | C4MGH0 | 1517 |
| *Artemisia vulgaris* (Mugwort, wormwood) | *Art v* 3.0301 | No | Nonspecific lipid transfer protein type 1 | ACE07188 | C4MGH1 | 1518 |
| *Artemisia vulgaris* (Mugwort, wormwood) | *Art v* 4.0101 | No | Profilin-1 | CAD12861 | Q8H2C9 | 1519 |
| *Artemisia vulgaris* (Mugwort, wormwood) | *Art v* 4.0201 | No | Profilin-2 | CAD12862 | Q8H2C8 | 1520 |
| *Artemisia vulgaris* (Mugwort, wormwood) | *Art v* 5 | No | Polcalcin | AAX85389 | A0PJ17 | 1521 |
| *Artemisia vulgaris* (Mugwort, wormwood) | *Art v* 6 | No | Pectate lyase | AAX85388 | A0PJ16 | 1522 |
| *Bertholletia excelsa* (Brazil nut) | *Ber e* 1 | Yes | 2S sulfur-rich seed storage albumin | AAA33010 | P04403 | 1523 |
| *Bertholletia excelsa* (Brazil nut) | *Ber e* 2 | Yes | 11S globulin seed storage protein | AAO38859 | Q84ND2 | 1524 |
| *Beta vulgaris* (Sugar beet) | *Beta v* 1 | No | Che a 1/Ole e 1 homolgue | P85983 | P85983 | 1525 |
| *Beta vulgaris* (Sugar beet) | *Beta v* 2 | No | Profilin, pollen | P85984 | P85984 | 1526 |
| *Betula verrucosa* (*Betula pendula*) (European white birch) | *Bet v* 1.0101 | No | Pathogenesis-related protein, PR-10, *Bet v* 1 family member 1-A | CAA33887 | P15494 | 1527 |
| *Betula verrucosa* (*Betula pendula*) (European white birch) | *Bet v* 1.0102 | No | Pathogenesis-related protein, PR-10, *Bet v* 1 family member 1-D/H | CAA54482 | P43177 | 1528 |
| *Betula verrucosa* (*Betula pendula*) (European white birch) | *Bet v* 1.0103 | No | Pathogenesis-related protein, PR-10, *Bet v* 1 family member 1-E | CAA54483 | P43178 | 1529 |
| *Betula verrucosa* (*Betula pendula*) (European white birch) | *Bet v* 1.0104 | No | Pathogenesis-related protein, PR-10, *Bet v* 1 family member 1-F/I | CAA54484 | P43179 | 1530 |
| *Betula verrucosa* (*Betula pendula*) (European white birch) | *Bet v* 1.0105 | No | Pathogenesis-related protein, PR-10, *Bet v* 1 family member 1-G | CAA54485 | P43180 | 1531 |
| *Betula verrucosa* (*Betula pendula*) (European white birch) | *Bet v* 1.0106 | No | Pathogenesis-related protein, PR-10, *Bet v* 1 family member 1-J | CAA54487 | P43183 | 1532 |
| *Betula verrucosa* (*Betula pendula*) (European white birch) | *Bet v* 1.0107 | No | Pathogenesis-related protein, PR-10, *Bet v* 1 family member 1-L | CAA54489 | P43185 | 1533 |
| *Betula verrucosa* (*Betula pendula*) (European white birch) | *Bet v* 1.0108 | No | / (pollen allergen) | CAB02155 | Q96365 | 1534 |
| *Betula verrucosa* (*Betula pendula*) (European white birch) | *Bet v* 1.0109 | No | / (pollen allergen) | CAB02156 | Q96366 | 1535 |
| *Betula verrucosa* (*Betula pendula*) (European white birch) | *Bet v* 1.0110 | No | / (pollen allergen) | CAB02157 | Q96367 | 1536 |
| *Betula verrucosa* (*Betula pendula*) (European white birch) | *Bet v* 1.0111 | No | / (pollen allergen) | CAB02158 | Q96368 | 1537 |
| *Betula verrucosa* (*Betula pendula*) (European white birch) | *Bet v* 1.0112 | No | Pathogenesis-related protein, PR-10, *Bet v* 1 family member 1-A | CAB02159 | P15494 (variant F63L) | 1538 |
| *Betula verrucosa* (*Betula pendula*) (European white birch) | *Bet v* 1.0113 | No | / (pollen allergen) | CAB02160 | Q96370 | 1539 |
| *Betula verrucosa* (*Betula pendula*) (European white birch) | *Bet v* 1.0114 | No | / (pollen allergen) | CAB02161 | Q96371 | 1540 |

TABLE 5-continued

Allergen proteins

| Species | Allergen | Food Allergen | Biochemical name | GenBank | Uniprot | SEQ ID NO |
|---|---|---|---|---|---|---|
| *Betula verrucosa* (*Betula pendula*) (European white birch) | *Bet v* 1.0115 | No | / (pollen allergen) | CAA96547 | Q39431 | 1541 |
| *Betula verrucosa* (*Betula pendula*) (European white birch) | *Bet v* 1.0116 | No | / (pollen allergen) | CAA04827.1 | O23748 | 1542 |
| *Betula verrucosa* (*Betula pendula*) (European white birch) | *Bet v* 1.0117 | No | / (pollen allergen), isoform at37 | CAA07323.1 | Q9SCI0 | 1543 |
| *Betula verrucosa* (*Betula pendula*) (European white birch) | *Bet v* 1.0118 | No | / (pollen allergen), isoform at5 | CAA07329.1 | Q9SCH6 | 1544 |
| *Betula verrucosa* (*Betula pendula*) (European white birch) | *Bet v* 1.0119 | No | Major allergen *Bet v* 1.01E | ABC41615.1 | Q0QLS9 | 1545 |
| *Betula verrucosa* (*Betula pendula*) (European white birch) | *Bet v* 1.0201 | No | Pathogenesis-related protein, PR-10, *Bet v* 1 family member 1-B | CAA54421 | P45431 | 1546 |
| *Betula verrucosa* (*Betula pendula*) (European white birch) | *Bet v* 1.0202 | No | Pathogenesis-related protein, PR-10, *Bet v* 1 family member 1-C | CAA54481 | P43176 | 1547 |
| *Betula verrucosa* (*Betula pendula*) (European white birch) | *Bet v* 1.0203 | No | Pathogenesis-related protein, PR-10, *Bet v* 1 family member 1-K | CAA54488 | P43184 | 1548 |
| *Betula verrucosa* (*Betula pendula*) (European white birch) | *Bet v* 1.0204 | No | Pathogenesis-related protein, PR-10, *Bet v* 1 family member 1-M/N | CAA57550 | P43186 | 1549 |
| *Betula verrucosa* (*Betula pendula*) (European white birch) | *Bet v* 1.0205 | No | / (pollen allergen) | CAA96540.1 | Q39427 | 1550 |
| *Betula verrucosa* (*Betula pendula*) (European white birch) | *Bet v* 1.0206 | No | / (pollen allergen) | CAA04828.1 | O23749 | 1551 |
| *Betula verrucosa* (*Betula pendula*) (European white birch) | *Bet v* 1.0207 | No | Major allergen *Bet v* 1.02C | ACF75030.1 | Q0QLV2 | 1552 |
| *Betula verrucosa* (*Betula pendula*) (European white birch) | *Bet v* 1.0301 | No | 1 Sc-3 protein | CAA54696.1 | Q39415 | 1553 |
| *Betula verrucosa* (*Betula pendula*) (European white birch) | *Bet v* 2 | No | Profilin | AAA16522 | P25816 | 1554 |
| *Betula verrucosa* (*Betula pendula*) (European white birch) | *Bet v* 3 | No | Polcalcin-like protein (4 EF-hand) | CAA55854 | P43187 | 1555 |
| *Betula verrucosa* (*Betula pendula*) (European white birch) | *Bet v* 4 | No | Polcalcin | CAA60628 | Q39419 | 1556 |
| *Betula verrucosa* (*Betula pendula*) (European white birch) | *Bet v* 6.0101 | No | PhenylCoumaran benzylic ether reductase | AAC05116 | O65002 | 1557 |
| *Betula verrucosa* (*Betula pendula*) (European white birch) | *Bet v* 6.0102 | No | PhenylCoumaran benzylic ether reductase | AAG22740 | Q9FUW6 | 1558 |
| *Betula verrucosa* (*Betula pendula*) (European white birch) | *Bet v* 7 | No | Cyclophilin (Peptidyl-prolyl cis-trans isomerase) | CAC84116 | P81531 | 1559 |
| *Brassica juncea* (Indian or oriental mustard) | *Bra j* 1 | Yes | 2S albumin seed storage protein | P80207 | P80207 | 1560 |
| *Brassica napus* (Rapeseed) | *Bra n* 1 | Yes | 2S albumin seed storage protein (Napin-3) | P80208 | P80208 | 1561 |
| *Brassica oleracea* (Cabbage and others) | *Bra o* 3 | Yes | non-specific lipid transfer protein type 1 | / | / | / |
| *Brassica rapa* (Field mustard or Turnip) | *Bra r* 1 | Yes | 2S albumin | CAA46782 | Q42473 | 1562 |
| *Brassica rapa* (Field mustard or Turnip) | *Bra r* 2 | Yes | Prohevein homologue (Chitin-binding allergen) | / | P81729 | 1563 |
| *Brassica rapa* (Field mustard or Turnip) | *Bra r* 5 | Yes | Polcalcin | BAA09634 | P69197 | 1564 |
| *Cannabis sativa* (Indian hemp) | *Can s* 3 | No | Non-specific lipid transfer protein type 1 | CCK33472 | W0U0V5 | 1565 |
| *Capsicum annuum* (Chilli or bell pepper) | *Cap a* 1 | Yes | Osmotin-like protein (thaumatin-like protein) | CAC34055 | Q9ARG0 | 1566 |
| *Capsicum annuum* (Chilli or bell pepper) | *Cap a* 2 | Yes | Profilin | CAD10376 | Q93YI9 | 1567 |

TABLE 5-continued

Allergen proteins

| Species | Allergen | Food Allergen | Biochemical name | GenBank | Uniprot | SEQ ID NO |
|---|---|---|---|---|---|---|
| *Carpinus betulus* (Hornbeam) | Car b 1.0101 | No | Pathogenesis-related protein, PR-10, *Bet v* 1 family member 1A and 1B | CAA47366 | P38949 | 1568 |
| *Carpinus betulus* (Hornbeam) | Car b 1.0102 | No | Pathogenesis-related protein, PR-10, *Bet v* 1 family member 1A and 1B | CAA47357 | P38949 (variant) | 1568 |
| *Carya illinoinensis* (Pecan) | Car i 1 | Yes | 2S albumin seed storage protein | AAO32314 | Q84XA9 | 1569 |
| *Carya illinoinensis* (Pecan) | Car i 2 | Yes | Vicilin-like protein | ABV49590 | B3STU4 | 1570 |
| *Carya illinoinensis* (Pecan) | Car i 4 | Yes | Legumin seed storage protein | ABW86978 | B5KVH4 | 1571 |
| *Castanea sativa* (Chestnut) | Cas s 1 | No | Pathogenesis-related protein, PR-10, *Bet v* 1 family member | ACJ23861 | B7TWE3 | 1572 |
| *Castanea sativa* (Chestnut) | Cas s 5 | Yes | Chitinase | AAB01895 | Q42428 | 1573 |
| *Castanea sativa* (Chestnut) | Cas s 8 | Yes | Non-specific lipid transfer protein type 1 | / | / | / |
| *Castanea sativa* (Chestnut) | Cas s 9 | Yes | Cytosolic class I small heat shock protein | CAE46905 | Q9ZS24 | 1574 |
| *Catharanthus roseus* (Rosy periwinkle) | Cat r 1 | No | Cyclophilin 9Peptidyl-prolyl cis-trans isomerase) | CAA59468 | I3QBM4 | 1575 |
| *Chenopodium album* (Lambsquarters) | Che a 1 | No | Ole e 1 homologue | AAL07319 | Q8LGR0 | 1576 |
| *Chenopodium album* (Lambsquarters) | Che a 2 | No | Profilin | AAL92870 | Q84V37 | 1577 |
| *Chenopodium album* (Lambsquarters) | Che a 3 | No | Polcalcin | AAL92871 | Q84V36 | 1578 |
| *Citrullus lanatus* (watermelon) | Citr l 2 | Yes | Profilin | AAU43733 | Q5XWE1 | 1579 |
| *Citrus limon* (Lemon) | Cit l 3 | Yes | Non-specific lipid-transfer protein | P84160 | P84160 | 1580 |
| *Citrus reticulata* (Tangerine) | Cit r 3 | Yes | Non-specific lipid transfer protein type 1 | P84161 | P84161 | 1581 |
| *Citrus sinensis* (Sweet orange) | Cit s 1 | Yes | Germin-like protein | P84159 | P84159 | 1582 |
| *Citrus sinensis* (Sweet orange) | Cit s 2 | Yes | Profilin | CAI23765 | P84177 | 1583 |
| *Citrus sinensis* (Sweet orange) | Cit s 3 | Yes | Non-specific lipid-transfer protein type 1 | CAH03799 | Q6EV47 | 1584 |
| *Citrus sinensis* (Sweet orange) | Cit s 7 | Yes | Gibberellin regulated protein | / | / | / |
| *Coffea arabica* (Arabian coffee) | Cof a 1 | No | Class III chitinase | ADH10372 | D7REL9 | 1585 |
| *Coffea arabica* (Arabian coffee) | Cof a 2 | No | Metallothionein type 2 | AGL34967 | AGL34967 | 1586 |
| *Coffea arabica* (Arabian coffee) | Cof a 3 | No | Metallothionein type 3 | AGL34968 | R4MUV4 | 1587 |
| *Corylus avellana* (Hazelnut) | Cor a 1.0101 | Yes | Pathogenesis-related protein, PR-10, *Bet v* 1 family member; isoform 5, 6, 11 and 16 | CAA50327 | Q08407 | 1588 |
| *Corylus avellana* (Hazelnut) | Cor a 1.0201 | Yes | Pathogenesis-related protein, PR-10, *Bet v* 1 family member | CAA96548 | Q39453 | 1589 |
| *Corylus avellana* (Hazelnut) | Cor a 1.0301 | Yes | Pathogenesis-related protein, PR-10, *Bet v* 1 family member | CAA96549 | Q39454 | 1590 |
| *Corylus avellana* (Hazelnut) | Cor a 1.0401 | Yes | Pathogenesis-related protein, PR-10, *Bet v* 1 family member | AAD48405 | Q9SWR4 | 1591 |
| *Corylus avellana* (Hazelnut) | Cor a 1.0402 | Yes | Pathogenesis-related protein, PR-10, *Bet v* 1 family member | AAG40329 | Q9FPK4 | 1592 |
| *Corylus avellana* (Hazelnut) | Cor a 1.0403 | Yes | Pathogenesis-related protein, PR-10, *Bet v* 1 family member | AAG40330 | Q9FPK3 | 1593 |
| *Corylus avellana* (Hazelnut) | Cor a 1.0404 | Yes | Pathogenesis-related protein, PR-10, *Bet v* 1 family member | AAG40331 | Q9FPK2 | 1594 |
| *Corylus avellana* (Hazelnut) | Cor a 2.0101 | Yes | Profilin | AAK01235 | Q9AXH5 | 1595 |
| *Corylus avellana* (Hazelnut) | Cor a 2.0102 | Yes | Profilin | AAK01236 | Q9AXH4 | 1596 |

TABLE 5-continued

Allergen proteins

| Species | Allergen | Food Allergen | Biochemical name | GenBank | Uniprot | SEQ ID NO |
|---|---|---|---|---|---|---|
| *Corylus avellana* (Hazelnut) | *Cor a* 6 | No | Isoflavone reductase homologue | / | / | / |
| *Corylus avellana* (Hazelnut) | *Cor a* 8 | Yes | Non-specific lipid transfer protein type 1 | AAK28533 | Q9ATH2 | 1597 |
| *Corylus avellana* (Hazelnut) | *Cor a* 9 | Yes | 11S seed storage globulin (legumin-like) | AAL73404 | Q8W1C2 | 1598 |
| *Corylus avellana* (Hazelnut) | *Cor a* 10 | No | Luminal binding protein | CAC14168 | Q9FSY7 | 1599 |
| *Corylus avellana* (Hazelnut) | *Cor a* 11 | Yes | 7S seed storage globulin (vicilin-like) | AAL86739 | Q8S4P9 | 1600 |
| *Corylus avellana* (Hazelnut) | *Cor a* 12 | Yes | 17 kDa oelosin | AAO67349 | Q84T21 | 1601 |
| *Corylus avellana* (Hazelnut) | *Cor a* 13 | Yes | 14-16 kDa oleosin | AAO65960 | Q84T91 | 1602 |
| *Corylus avellana* (Hazelnut) | *Cor a* 14 | Yes | 2S albumin | ACO56333 | D0PWG2 | 1603 |
| *Cucumis melo* (Muskmelon) | *Cuc m* 1 | Yes | Alkaline serine protease (cucumisin) | BAA06905 | Q39547 | 1604 |
| *Cucumis melo* (Muskmelon) | *Cuc m* 2 | Yes | Profilin | AAW69549 | Q5FX67 | 1605 |
| *Cucumis melo* (Muskmelon) | *Cuc m* 3 | Yes | Pathogenesis-related protein PR-1 | P83834 | P83834 | 1606 |
| *Daucus carota* (Carrot) | *Dau c* 1.0101 | Yes | Pathogenesis-related protein, PR-10, *Bet v* 1 family member | AAB01092 | O04298 | 1607 |
| *Daucus carota* (Carrot) | *Dau c* 1.0201 | Yes | Pathogenesis-related protein, PR-10, *Bet v* 1 family member | AAL76932 | Q8SAE7 | 1608 |
| *Daucus carota* (Carrot) | *Dau c* 1.0301 | Yes | PRP-like protein | ADL32660 | D9ZHN9 | 1609 |
| *Daucus carota* (Carrot) | *Dau c* 4 | Yes | Profilin | AAL76933 | Q8SAE6 | 1610 |
| *Daucus carota* (Carrot) | *Dau c* 5 | Yes | Isoflavone reductase-like protein | AEY79728 | H2DF86 | 1611 |
| *Fagopyrum esculentum* (Common buckwheat) | *Fag e* 2 | Yes | 2S albumin | ABC18306 | Q2PS07 | 1612 |
| *Fagopyrum esculentum* (Common buckwheat) | *Fag e* 3 | Yes | Vicilin | ABQ10638 | A5HIX6 | 1613 |
| *Fagopyrum esculentum* (Common buckwheat) | *Fag e* 4.0101 | Yes | Antimicrobial Peptide | / | P0DKH7 | 1614 |
| *Fagopyrum esculentum* (Common buckwheat) | *Fag e* 4.0102 | Yes | Antimicrobial Peptide | / | P0DKH8 | 1615 |
| *Fagopyrum esculentum* (Common buckwheat) | *Fag e* 5 | Yes | Vicilin-like protein | AY536051.1 | Q6QJL1 | 1616 |
| *Fagopyrum tataricum* (Tartarian buckwheat) | *Fag t* 2 | Yes | 2S albumin | ADW27428 | E9NX73 | 1617 |
| *Fagus sylvatica* (European beech) | *Fag s* 1 | No | Pathogenesis-related protein, PR-10, *Bet v* 1 family member | ACJ23864 | B7TWE6 | 1618 |
| *Fragaria ananassa* (Strawberry) | *Fra a* 1 | Yes | Pathogenesis-related protein, PR-10, *Bet v* 1 family member | CAJ29538.1 | Q3T923 | 1619 |
| *Fragaria ananassa* (Strawberry) | *Fra a* 3.0101 | Yes | Non-specific lipid transfer protein type 1 (ltp6) | CAC86258 | Q8VX12 | 1620 |
| *Fragaria ananassa* (Strawberry) | *Fra a* 3.0102 | Yes | Non-specific lipid transfer protein type 1 (ltp2) | AAY83342 | Q4PLT9 | 1621 |
| *Fragaria ananassa* (Strawberry) | *Fra a* 3.0201 | Yes | Non-specific lipid transfer protein type 1 (ltp1) | AAY83341 | Q4PLU0 | 1622 |
| *Fragaria ananassa* (Strawberry) | *Fra a* 3.0202 | Yes | Non-specific lipid transfer protein type 1 (ltp5) | AAY83345 | Q4PLT6 | 1623 |
| *Fragaria ananassa* (Strawberry) | *Fra a* 4 | Yes | Profolin | XP_004287490 | P0C0Y3 | 1624 |
| *Fraxinus excelsior* (Ash) | *Fra e* 1.0101 | No | Ole e 1-like protein family member | AAQ08947 | Q7XAV4 | 1625 |
| *Fraxinus excelsior* (Ash) | *Fra e* 1.0102 | No | Ole e 1-like protein family member | AAV74343 | Q5EXJ6 | 1626 |
| *Fraxinus excelsior* (Ash) | *Fra e* 1.0201 | No | Ole e 1-like protein family member | AAQ83588 | Q6U740 | 1627 |
| *Glycine max* (Soybean) | *Gly m* 1 | No | Hydrophobic protein from soybean | Q9S8F3 | Q9S8F3 | 1628 |
| *Glycine max* (Soybean) | *Gly m* 2 | No | Defensin | / | / | / |
| *Glycine max* (Soybean) | *Gly m* 3.0101 | Yes | Profilin-1 | CAA11756 | O65809 | 1629 |
| *Glycine max* (Soybean) | *Gly m* 3.0102 | Yes | Profilin-2 | CAA11755 | O65810 | 1630 |

TABLE 5-continued

Allergen proteins

| Species | Allergen | Food Allergen | Biochemical name | GenBank | Uniprot | SEQ ID NO |
|---|---|---|---|---|---|---|
| *Glycine max* (Soybean) | *Gly m* 4 | Yes | Stress-induced protein SAM22 | CAA42646 | P26987 | 1631 |
| *Glycine max* (Soybean) | *Gly m* 5.0101 | Yes | alpha subunit of Beta-conglycinin (vicilin, 7S globulin) | BAA23360 | O22120 | 1632 |
| *Glycine max* (Soybean) | *Gly m* 5.0201 | Yes | alpha subunit of Beta-conglycinin (vicilin, 7S globulin) | BAA74452 | Q9FZP9 | 1633 |
| *Glycine max* (Soybean) | *Gly m* 5.0301 | Yes | beta chain of Beta-conglycinin | AAB23463 | P25974 (variant F36L V51G F197L) | 1634 |
| *Glycine max* (Soybean) | *Gly m* 6.0101 | Yes | Glycinin G1 (legumin, 11S globulin) | BAC78522 | P04776 | 1635 |
| *Glycine max* (Soybean) | *Gly m* 6.0201 | Yes | Glycinin G2 | BAA00154 | P04405 | 1636 |
| *Glycine max* (Soybean) | *Gly m* 6.0301 | Yes | Glycinin G3 | CAA33217 | P11828 | 1637 |
| *Glycine max* (Soybean) | *Gly m* 6.0401 | Yes | Glycinin | BAA74953 | Q9SB11 | 1638 |
| *Glycine max* (Soybean) | *Gly m* 6.0501 | Yes | Glycinin A3B4 subunit | BAB15802 | Q7GC77 | 1639 |
| *Glycine max* (Soybean) | *Gly m* 7 | Yes | Seed biotinylated protein | ACS49840 | C6K8D1 | 1640 |
| *Glycine max* (Soybean) | *Gly m* 8 | Yes | 2S albumin | AAB71140 | P19594 | 1641 |
| *Helianthus annuus* (Sunflower) | *Hel a* 1 | No | / | / | / | / |
| *Helianthus annuus* (Sunflower) | *Hel a* 2 | No | Profilin | CAA75506 | O81982 | 1642 |
| *Helianthus annuus* (Sunflower) | *Hel a* 3 | Yes | Non-specific lipid transfer protein type 1 | AAP47226 | Q7X9Q5 | 1643 |
| *Hevea brasiliensis* (Para rubber tree (latex)) | *Hev b* 1 | No | Rubber elongation factor | CAA39880 | P15252 | 1644 |
| *Hevea brasiliensis* (Para rubber tree (latex)) | *Hev b* 2 | No | beta-1,3-glucanase, basic vacuolar isoform | AAA87456 | P52407 | 1645 |
| *Hevea brasiliensis* (Para rubber tree (latex)) | *Hev b* 3 | No | Small rubber particle protein | AAC82355 | O82803 | 1646 |
| *Hevea brasiliensis* (Para rubber tree (latex)) | *Hev b* 4 | No | Lecithinase homologue | AAR98518 | Q6T4P0 | 1647 |
| *Hevea brasiliensis* (Para rubber tree (latex)) | *Hev b* 5 | No | / | AAC49447 | Q39967 | 1648 |
| *Hevea brasiliensis* (Para rubber tree (latex)) | *Hev b* 6 | No | Hevein precursor | AAA33357 | P02877 | 1649 |
| *Hevea brasiliensis* (Para rubber tree (latex)) | *Hev b* 7 | No | Patatin-like protein | AAC27724 | O04008 | 1650 |
| *Hevea brasiliensis* (Para rubber tree (latex)) | *Hev b* 8.0101 | No | Profilin-1 | CAA75312 | O65812 | 1651 |
| *Hevea brasiliensis* (Para rubber tree (latex)) | *Hev b* 8.0102 | No | Profilin-2 | CAB51914 | Q9STB6 | 1652 |
| *Hevea brasiliensis* (Para rubber tree (latex)) | *Hev b* 8.0201 | No | Profilin-3 | AAF34341 | Q9M7N0 | 1653 |
| *Hevea brasiliensis* (Para rubber tree (latex)) | *Hev b* 8.0202 | No | Profilin-4 | AAF34342 | Q9M7M9 | 1654 |
| *Hevea brasiliensis* (Para rubber tree (latex)) | *Hev b* 8.0203 | No | Profilin-5 | AAF34343 | Q9M7M8 | 1655 |
| *Hevea brasiliensis* (Para rubber tree (latex)) | *Hev b* 8.0204 | No | Profilin-6 | CAB96215 | Q9LEI8 | 1656 |
| *Hevea brasiliensis* (Para rubber tree (latex)) | *Hev b* 9 | No | Enolase | CAC00532 | Q9LEJ0 | 1657 |
| *Hevea brasiliensis* (Para rubber tree (latex)) | *Hev b* 10.0101 | No | Superoxide dismutase (Mn), mitochondrial | AAA16792 | P35017 | 1658 |
| *Hevea brasiliensis* (Para rubber tree (latex)) | *Hev b* 10.0102 | No | Superoxide dismutase | CAB53458 | Q9STB5 | 1659 |
| *Hevea brasiliensis* (Para rubber tree (latex)) | *Hev b* 10.0103 | No | Superoxide dismutase | CAC13961 | Q9FSJ2 | 1660 |
| *Hevea brasiliensis* (Para rubber tree (latex)) | *Hev b* 11.0101 | No | Class I chitinase | CAC42881 | Q949H3 | 1661 |
| *Hevea brasiliensis* (Para rubber tree (latex)) | *Hev b* 11.0102 | No | Class I chitinase | CAD24068 | Q8GUD7 | 1662 |
| *Hevea brasiliensis* (Para rubber tree (latex)) | *Hev b* 12 | No | Non-specific lipid transfer protein type 1 | AAL25839 | Q8RYA8 | 1663 |
| *Hevea brasiliensis* (Para rubber tree (latex)) | *Hev b* 13 | No | Esterase | AAP37470 | Q7Y1X1 | 1664 |
| *Hevea brasiliensis* (Para rubber tree (latex)) | *Hev b* 14 | No | Hevamine | ADR82196 | E7BQV3 | 1665 |

TABLE 5-continued

Allergen proteins

| Species | Allergen | Food Allergen | Biochemical name | GenBank | Uniprot | SEQ ID NO |
|---|---|---|---|---|---|---|
| *Hevea brasiliensis* (Para rubber tree (latex)) | *Hev b* 15 | No | Serine protease inhibitor | CCW27997 | W0USW9 | 1666 |
| *Humulus japonicus* (Japanese hop) | *Hum j* 1 | No | / | AAP94213 | Q7XBE3 | 1667 |
| *Juglans nigra* (Black walnut) | *Jug n* 1 | Yes | 2S albumin seed storage protein | AAM54365 | Q7Y1C2 | 1668 |
| *Juglans nigra* (Black walnut) | *Jug n* 2 | Yes | Vicilin seed storage protein | AAM54366 | Q7Y1C1 | 1669 |
| *Juglans nigra* (Black walnut) | *Jug n* 4 | Yes | Legumin | / | / | / |
| *Juglans regia* (English walnut) | *Jug r* 1 | Yes | 2S albumin seed storage protein | AAB41308 | P93198 | 1670 |
| *Juglans regia* (English walnut) | *Jug r* 2 | Yes | Vicilin seed storage protein | AAF18269 | Q9SEW4 | 1671 |
| *Juglans regia* (English walnut) | *Jug r* 3 | Yes | Non-specific lipid transfer protein type 1 | ACI47547 | C5H617 | 1672 |
| *Juglans regia* (English walnut) | *Jug r* 4 | Yes | 11S globulin seed storage protein | AAW29810 | Q2TPW5 | 1673 |
| *Juglans regia* (English walnut) | *Jug r* 5 | Yes | Pathogenesis Related protein-10 | APD76154.1 | / | 1674 |
| *Juglans regia* (English walnut) | *Jug r* 6 | Yes | vicilin-like cupin | / | / | / |
| *Kochia scoparia* (Burning bush) | *Koc s* 1 | No | Ole e 1-like protein | AKV72169 | A0A0K1SC44 | 1675 |
| *Kochia scoparia* (Burning bush) | *Koc s* 2 | No | profilin | AIV43661.1 | / | 1676 |
| *Lactuca sativa* (Cultivated lettuce) | *Lac s* 1 | Yes | Non-specific lipid transfer protein | / | / | / |
| *Lens culinaris* (Lentil) | *Len c* 1.0101 | Yes | Gamma-vicilin subunit | CAD87730 | Q84UI1 | 1677 |
| *Lens culinaris* (Lentil) | *Len c* 1.0102 | Yes | Gamma-vicilin subunit | CAD87731 | Q84UI0 | 1678 |
| *Lens culinaris* (Lentil) | *Len c* 2 | Yes | Seed-specific biotinylated protein | / | / | / |
| *Lens culinaris* (Lentil) | *Len c* 3 | Yes | Nonspecific lipid transfer protein type 1 | AAX35807 | A0AT29 | 1679 |
| *Ligustrum vulgare* (Common privet) | *Lig v* 1 | No | Ole e 1-like protein family member | CAA54818 | O82015 | 1680 |
| *Litchi chinensis* (Lychee) | *Lit c* 1 | Yes | Profilin | AAL07320 | Q941H7 | 1681 |
| *Lupinus* (*albus*) | *Lup a* 5 | Yes | Profilin | / | / | / |
| *Lupinus angustifolius* (Narrow-leaved blue lupin) | *Lup an* 1 | Yes | Conglutin beta (7S seed storage globulin, vicilin) | ACB05815 | B8Q5G0 | 1682 |
| *Malus domestica* (Apple) | *Mal d* 1.0101 | Yes | Pathogenesis-related protein, PR-10, *Bet v* 1 family member | CAA58646 | P43211 | 1683 |
| *Malus domestica* (Apple) | *Mal d* 1.0103 | Yes | Pathogenesis-related protein, PR-10, *Bet v* 1 family member | AAD26546 | Q9SYV2 | 1684 |
| *Malus domestica* (Apple) | *Mal d* 1.0104 | Yes | Pathogenesis-related protein, PR-10, *Bet v* 1 family member | AAD26552 | Q9SYV5 | 1685 |
| *Malus domestica* (Apple) | *Mal d* 1.0105 | Yes | Pathogenesis-related protein, PR-10, *Bet v* 1 family member | AAD26553 | Q9SYV6 | 1686 |
| *Malus domestica* (Apple) | *Mal d* 1.0106 | Yes | Pathogenesis-related protein, PR-10, *Bet v* 1 family member | AAD26554 | Q9SYV7 | 1687 |
| *Malus domestica* (Apple) | *Mal d* 1.0107 | Yes | Pathogenesis-related protein, PR-10, *Bet v* 1 family member | AAD26555 | Q9SYV8 | 1688 |
| *Malus domestica* (Apple) | *Mal d* 1.0108 | Yes | Pathogenesis-related protein, PR-10, *Bet v* 1 family member | AAD29671 | Q9SYW3 | 1689 |
| *Malus domestica* (Apple) | *Mal d* 1.0109 | Yes | Pathogenesis-related protein, PR-10, *Bet v* 1 family member | AAK13029 | Q941P6 | 1690 |
| *Malus domestica* (Apple) | *Mal d* 1.0201 | Yes | Pathogenesis-related protein, PR-10, *Bet v* 1 family member | AAB01362 | Q40280 | 1691 |
| *Malus domestica* (Apple) | *Mal d* 1.0202 | Yes | Pathogenesis-related protein, PR-10, *Bet v* 1 family member | AAD26545 | Q9S7M5 | 1691 |

TABLE 5-continued

Allergen proteins

| Species | Allergen | Food Allergen | Biochemical name | GenBank | Uniprot | SEQ ID NO |
|---|---|---|---|---|---|---|
| *Malus domestica* (Apple) | *Mal d* 1.0203 | Yes | Pathogenesis-related protein, PR-10, *Bet v* 1 family member | AAD26547 | Q9SYV3 | 1692 |
| *Malus domestica* (Apple) | *Mal d* 1.0204 | Yes | Pathogenesis-related protein, PR-10, *Bet v* 1 family member | AAD26548 | Q9SYV4 | 1693 |
| *Malus domestica* (Apple) | *Mal d* 1.0205 | Yes | Pathogenesis-related protein, PR-10, *Bet v* 1 family member | AAD26558 | Q9SYV9 | 1694 |
| *Malus domestica* (Apple) | *Mal d* 1.0206 | Yes | Pathogenesis-related protein, PR-10, *Bet v* 1 family member | AAD13683 | Q40280 | 1695 |
| *Malus domestica* (Apple) | *Mal d* 1.0207 | Yes | Ribonuclease-like PR-10a | AAK13030 | Q941P5 | 1696 |
| *Malus domestica* (Apple) | *Mal d* 1.0208 | Yes | Pathogenesis-related protein, PR-10, *Bet v* 1 family member | CAD32318 | Q8L6K9 | 1697 |
| *Malus domestica* (Apple) | *Mal d* 1.0301 | Yes | Pathogenesis-related protein, PR-10, *Bet v* 1 family member | CAA96534 | Q43549 | 1698 |
| *Malus domestica* (Apple) | *Mal d* 1.0302 | Yes | Pathogenesis-related protein, PR-10, *Bet v* 1 family member | AAK13027 | Q941P8 | 1699 |
| *Malus domestica* (Apple) | *Mal d* 1.0303 | Yes | Pathogenesis-related protein, PR-10, *Bet v* 1 family member | AAK13028 | Q941P7 | 1700 |
| *Malus domestica* (Apple) | *Mal d* 1.0304 | Yes | Pathogenesis-related protein, PR-10, *Bet v* 1 family member | AAO25113 | Q84LA7 | 1701 |
| *Malus domestica* (Apple) | *Mal d* 1.0401 | Yes | Pathogenesis-related protein, PR-10, *Bet v* 1 family member | CAA96535 | Q43550 | 1702 |
| *Malus domestica* (Apple) | *Mal d* 1.0402 | Yes | Pathogenesis-related protein, PR-10, *Bet v* 1 family member | CAA96536 | Q43551 | 1703 |
| *Malus domestica* (Apple) | *Mal d* 1.0403 | Yes | Pathogenesis-related protein, PR-10, *Bet v* 1 family member | CAA96537 | Q43552 | 1704 |
| *Malus domestica* (Apple) | *Mal d* 2 | Yes | Thaumatin-like protein | AAC36740 | Q9FSG7 | 1705 |
| *Malus domestica* (Apple) | *Mal d* 3.0101w | Yes | Non-specific lipid transfer protein type 1 | AAT80637 | Q5J026 | 1706 |
| *Malus domestica* (Apple) | *Mal d* 3.0102w | Yes | Non-specific lipid transfer protein type 1 | AAT80649 | Q5J011 | 1707 |
| *Malus domestica* (Apple) | *Mal d* 3.0201w | Yes | Non-specific lipid transfer protein type 1 | AAT80656 | Q5J009 | 1708 |
| *Malus domestica* (Apple) | *Mal d* 3.0202w | Yes | Non-specific lipid transfer protein type 1 | AAT80664 | Q5IZZ6 | 1709 |
| *Malus domestica* (Apple) | *Mal d* 3.0203w | Yes | Non-specific lipid transfer protein type 1 | AAT80665 | Q5IZZ5 | 1710 |
| *Malus domestica* (Apple) | *Mal d* 4.0101 | Yes | Profilin-3 | AAD29414 | Q9XF42 | 1711 |
| *Malus domestica* (Apple) | *Mal d* 4.0102 | Yes | Profilin (pf-3) | CAD46561 | Q84RR5 | 1712 |
| *Malus domestica* (Apple) | *Mal d* 4.0201 | Yes | Profilin-2 | AAD29413 | Q9XF41 | 1713 |
| *Malus domestica* (Apple) | *Mal d* 4.0202 | Yes | Profilin (pf-2) | CAD46560 | Q84RR6 | 1714 |
| *Malus domestica* (Apple) | *Mal d* 4.0301 | Yes | Profilin-1 | AAD29412 | Q9XF40 | 1715 |
| *Malus domestica* (Apple) | *Mal d* 4.0302 | Yes | Profilin (pf-1) | CAD46559 | Q84RR7 | 1716 |
| *Manihot esculenta* (Cassava, manioc) | *Man e* 5 | Yes | Glutamic acid rich protein | AEE98392 | M1E7Y0 | 1717 |
| *Mercurialis annua* (Annual mercury) | *Mer a* 1 | No | Profilin | CAA73720 | O49894 | 1718 |
| *Morus nigra* (Mulberry) | *Mor n* 3 | Yes | Non-specific lipid transfer protein type 1 | P85894 | P85894 | 1719 |
| *Olea europaea* (Olive) | *Ole e* 1 | No | Common olive group 1 | AAB32652 | P19963 | 1720 |
| *Olea europaea* (Olive) | *Ole e* 2 | No | Profilin-1 | CAA73035 | O24169 | 1721 |
| *Olea europaea* (Olive) | *Ole e* 3 | No | Polcalcin | AAD05375 | O81092 | 1722 |
| *Olea europaea* (Olive) | *Ole e* 4 | No | major pollen allergen | P80741 | P80741 | 1723 |
| *Olea europaea* (Olive) | *Ole e* 5 | No | Superoxide dismutase [Cu—Zn] | P80740 | P80740 | 1724 |
| *Olea europaea* (Olive) | *Ole e* 6 | No | major pollen allergen | AAB66909 | O24172 | 1725 |

TABLE 5-continued

Allergen proteins

| Species | Allergen | Food Allergen | Biochemical name | GenBank | Uniprot | SEQ ID NO |
|---|---|---|---|---|---|---|
| *Olea europaea* (Olive) | *Ole e* 7 | No | putative non-specific lipid transfer protein | P81430 | P81430 | 1726 |
| *Olea europaea* (Olive) | *Ole e* 8 | No | Polcalcin-like protein (4 EF-hands) | AAF31151 | Q9M7R0 | 1727 |
| *Olea europaea* (Olive) | *Ole e* 9 | No | 1 3-beta glucanase | AAK58515 | Q94G86 | 1728 |
| *Olea europaea* (Olive) | *Ole e* 10 | No | X8 domain containing protein | AAL92578 | Q84V39 | 1729 |
| *Olea europaea* (Olive) | *Ole e* 11 | No | Pectin methylesterase | ACZ57582 | D8VPP5 | 1730 |
| *Ostrya carpinifolia* (European hophornbeam) | *Ost c* 1 | No | Pathogenesis-related protein, PR-10, *Bet v* 1 family member | ADK39021 | E2GL17 | 1731 |
| *Parietaria judaica* (Pellitory-of-the-Wall) | *Par j* 1.0101 | No | Probable non-specific lipid-transfer protein | CAA54587 | P43217 | 1732 |
| *Parietaria judaica* (Pellitory-of-the-Wall) | *Par j* 1.0102 | No | Probable non-specific lipid-transfer protein 1 | CAA65123 | O04404 | 1733 |
| *Parietaria judaica* (Pellitory-of-the-Wall) | *Par j* 1.0103 | No | Probable non-specific lipid-transfer protein | CAI94601 | Q1JTN5 | 1734 |
| *Parietaria judaica* (Pellitory-of-the-Wall) | *Par j* 1.0201 | No | Probable non-specific lipid-transfer protein 1 | CAA59370 | Q40905 | 1735 |
| *Parietaria judaica* (Pellitory-of-the-Wall) | *Par j* 2.0101 | No | Phospholipid transfer protein | CAA65121 | P55958 | 1736 |
| *Parietaria judaica* (Pellitory-of-the-Wall) | *Par j* 2.0102 | No | Phospholipid transfer protein | CAA65122 | O04403 | 1737 |
| *Parietaria judaica* (Pellitory-of-the-Wall) | *Par j* 3.0101 | No | Profilin-1 | CAB44256 | Q9XG85 | 1738 |
| *Parietaria judaica* (Pellitory-of-the-Wall) | *Par j* 3.0102 | No | Profilin-2 | CAB44257 | Q9T0M8 | 1739 |
| *Parietaria judaica* (Pellitory-of-the-Wall) | *Par j* 3.0201 | No | Profilin | CCP19647 | L8BTD8 | 1740 |
| *Parietaria judaica* (Pellitory-of-the-Wall) | *Par j* 4 | No | Polcalcin | CAP05019 | B5QST3 | 1741 |
| *ietaria officinalis* (Pellitory) | *Par o* 1 | No | Phospholipid transfer protein | / | / | / |
| *Parthenium hysterophorus* (Feverfew) | *Par h* 1 | No | pollen defensin-like protein | AKF12278 | A0A0X9C7K4 | 1742 |
| *Persea americana* (Avocado) | *Pers a* 1 | Yes | Endochitinase | CAB01591 | P93680 | 1743 |
| *Phaseolus vulgaris* (Green bean, French bean) | *Pha v* 3.0101 | Yes | non-specific lipid transfer protein type 1 | ADC80502 | D3W146 | 1744 |
| *Phaseolus vulgaris* (Green bean, French bean) | *Pha v* 3.0201 | Yes | non-specific lipid transfer protein type 1 | ADC80503 | D3W147 | 1745 |
| *Pistacia vera* (Pistachio) | *Pis v* 1 | Yes | 2S albumin | ABG73108 | B7P072 | 1746 |
| *Pistacia vera* (Pistachio) | *Pis v* 2.0101 | Yes | 11S globulin subunit presucor | ABG73109 | B7P073 | 1747 |
| *Pistacia vera* (Pistachio) | *Pis v* 2.0201 | Yes | 11S globulin subunit presucor | ABG73110 | B7P074 | 1748 |
| *Pistacia vera* (Pistachio) | *Pis v* 3 | Yes | vicillin | ABO36677 | B4X640 | 1749 |
| *Pistacia vera* (Pistachio) | *Pis v* 4 | Yes | manganese superoxide dismutase | ABR29644 | B2BDZ8 | 1750 |
| *Pistacia vera* (Pistachio) | *Pis v* 5 | Yes | 11S globulin subunit | ACB55490 | B7SLJ1 | 1751 |
| *Pisum sativum* (Pea) | *Pis s* 1.0101 | Yes | Vicilin | CAF25232 | Q702P1 | 1752 |
| *Pisum sativum* (Pea) | *Pis s* 1.0102 | Yes | Vicilin | CAF25233 | Q702P0 | 1753 |
| *Pisum sativum* (Pea) | *Pis s* 2 | Yes | Convicilin | CAB82855 | P13915 | 1754 |
| *Pisum sativum* (Pea) | *Pis s* 3 | Yes | Non-specific lipid-transfer protein 1 | AJG44053 | C0HJR7 | 1755 |
| *Plantago lanceolata* (English plantain) | *Pla l* 1.0101 | No | Ole e 1-related protein | CAC41633 | P82242 | 1756 |
| *Plantago lanceolata* (English plantain) | *Pla l* 1.0102 | No | Ole e 1-related protein | CAC41634 | P82242 (variant D58G) | 1756 |
| *Plantago lanceolata* (English plantain) | *Pla l* 1.0103 | No | Ole e 1-related protein | CAC41635 | P82242 (variant D58G S82G) | 1756 |
| *Plantago lanceolata* (English plantain) | *Pla l* 2 | No | Profilin | / | C0HJX6 | 1757 |
| *Platanus acerifolia* (London plane tree) | *Pla a* 1 | No | Putative invertase inhibitor | CAD20556 | Q8GT41 | 1758 |
| *Platanus acerifolia* (London plane tree) | *Pla a* 2 | No | Polygalacturonase | CAE52833 | Q6H9K0 | 1759 |

TABLE 5-continued

Allergen proteins

| Species | Allergen | Food Allergen | Biochemical name | GenBank | Uniprot | SEQ ID NO |
|---|---|---|---|---|---|---|
| *Platanus acerifolia* (London plane tree) | *Pla a* 3 | No | Non-specific lipid transfer protein 1 | / | / | / |
| *Platanus orientalis* (Oriental plane) | *Pla or* 1 | No | Plant invertase/pectin methylesterase inhibitor | ABY21305 | A9YUH4 | 1760 |
| *Platanus orientalis* (Oriental plane) | *Pla or* 2 | No | Polygalacturonase | ABY21306 | A9YUH5 | 1761 |
| *Platanus orientalis* (Oriental plane) | *Pla or* 3 | No | Non-specific lipid-transfer protein 1 | ABY21307 | A9YUH6 | 1762 |
| *Prosopis juliflora* (Mesquite) | *Pro j* 1 | No | Ole e 1-like protein | AKV72167.1 | / | 1763 |
| *Prosopis juliflora* (Mesquite) | *Pro j* 2 | No | Profilin | AHY24177 | A0A023W2L7 | 1764 |
| *Prunus armeniaca* (Apricot) | *Pru ar* 1 | Yes | Pathogenesis-related protein, PR-10, *Bet v* 1 family member | AAB97141 | O50001 | 1765 |
| *Prunus armeniaca* (Apricot) | *Pru ar* 3 | Yes | Non-specific lipid transfer protein 1 | P81651 | P81651 | 1766 |
| *Prunus avium* (Sweet cherry) | *Pru av* 1.0101 | Yes | Pathogenesis-related protein, PR-10, *Bet v* 1 family member | AAC02632 | O24248 | 1767 |
| *Prunus avium* (Sweet cherry) | *Pru av* 1.0201 | Yes | Pathogenesis-related protein, PR-10, *Bet v* 1 family member | AAS47035 | Q6QHU3 | 1768 |
| *Prunus avium* (Sweet cherry) | *Pru av* 1.0202 | Yes | Pathogenesis-related protein, PR-10, *Bet v* 1 family member | AAS47036 | Q6QHU2 | 1769 |
| *Prunus avium* (Sweet cherry) | *Pru av* 1.0203 | Yes | Pathogenesis-related protein, PR-10, *Bet v* 1 family member | AAS47037 | Q6QHU1 | 1770 |
| *Prunus avium* (Sweet cherry) | *Pru av* 2 | Yes | Thaumatin-like protein | AAB38064 | P50694 | 1771 |
| *Prunus avium* (Sweet cherry) | *Pru av* 3 | Yes | Non-specific lipid transfer protein 1 (nsLTP1) | AAF26449 | Q9M5X8 | 1772 |
| *Prunus avium* (Sweet cherry) | *Pru av* 4 | Yes | Profilin | AAD29411 | Q9XF39 | 1773 |
| *Prunus domestica* (European plum) | *Pru d* 3 | Yes | Non-specific lipid transfer protein 1 (nsLTP1) | P82534 | P82534 | 1774 |
| *Prunus dulcis* (Almond) | *Pru du* 3 | Yes | Non-specific lipid transfer protein 1 (nsLTP1) | ACN11576 | C0L0I5 | 1775 |
| *Prunus dulcis* (Almond) | *Pru du* 4 | Yes | Profilin | AAL91662 | Q8GSL5 | 1776 |
| *Prunus dulcis* (Almond) | *Pru du* 5 | Yes | 60s acidic ribosomal prot. P2 | ABH03379 | Q8H2B9 | 1777 |
| *Prunus dulcis* (Almond) | *Pru du* 6.0101 | Yes | Prunin-1 (Amandin, 11S globulin legumin-like protein) | ADN39440 | E3SH28 | 1778 |
| *Prunus dulcis* (Almond) | *Pru du* 6.0201 | Yes | Prunin-2 | ADN39441 | E3SH29 | 1779 |
| *Prunus mume* (Japanese apricot) | *Pru m* 7 | Yes | gibberellin-regulated protein | XP_016648029.1 | / | 1780 |
| *Prunus persica* (Peach) | *Pru p* 1 | Yes | Pathogenesis-related protein, PR-10, *Bet v* 1 family member | ABB78006 | Q2I6V8 | 1781 |
| *Prunus persica* (Peach) | *Pru p* 2.0101 | Yes | Thaumatin-like protein | ACE80959 | B6CQT7 | 1782 |
| *Prunus persica* (Peach) | *Pru p* 2.0201 | Yes | Thaumatin-like protein | ACE80957 | B6CQT5 | 1783 |
| *Prunus persica* (Peach) | *Pru p* 2.0301 | Yes | Thaumatin-like protein | ACE80955 | B6CQT3 | 1784 |
| *Prunus persica* (Peach) | *Pru p* 3.0101 | Yes | Non-specific lipid transfer protein 1 (nsLTP1) | P81402 | P81402 | 1785 |
| *Prunus persica* (Peach) | *Pru p* 3.0102 | Yes | Non-specific lipid transfer protein 1 (nsLTP1) | CAB96876 | Q9LED1 | 1786 |
| *Prunus persica* (Peach) | *Pru p* 4 | Yes | Profilin | CAD37201 | Q8GT40 | 1787 |
| *Prunus persica* (Peach) | *Pru p* 7 | Yes | Gibberellin-regulated protein | P86888 | P86888 | 1788 |
| *Punica granatum* (Pomegranate) | *Pun g* 1.0101 | Yes | Non-specific lipid transfer protein 1 (nsLTP1) | AHB19227 | A0A059STC4 | 1789 |
| *Punica granatum* (Pomegranate) | *Pun g* 1.0201 | Yes | Non-specific lipid transfer protein 1 (nsLTP1) | AHB19226 | A0A059SSZ0 | 1790 |
| *Punica granatum* (Pomegranate) | *Pun g* 1.0301 | Yes | Non-specific lipid transfer protein 1 (nsLTP1) | AHB19225 | A0A059ST23 | 1791 |
| *Pyrus communis* (Pear) | *Pyr c* 1 | Yes | Pathogenesis-related protein, PR-10, *Bet v* 1 family member | AAC13315 | O65200 | 1792 |

TABLE 5-continued

Allergen proteins

| Species | Allergen | Food Allergen | Biochemical name | GenBank | Uniprot | SEQ ID NO |
|---|---|---|---|---|---|---|
| *Pyrus communis* (Pear) | *Pyr c* 3 | Yes | Nonspecific lipid-transfer protein 1 | AAF26451 | Q9M5X6 | 1793 |
| *Pyrus communis* (Pear) | *Pyr c* 4 | Yes | Profilin | AAD29410 | Q9XF38 | 1794 |
| *Pyrus communis* (Pear) | *Pyr c* 5 | Yes | Isoflavone reductase related protein, putative phenylcoumaran benzylic ether reductase | AAC24001 | O81355 | 1795 |
| *Quercus alba* (White oak) | *Que a* 1.0201 | No | Pathogenesis-related protein, PR-10, *Bet v* 1 family member | ABZ81045 | B6RQS1 | 1796 |
| *Quercus alba* (White oak) | *Que a* 1.0301 | No | Pathogenesis-related protein, PR-10, *Bet v* 1 family member | ABZ81046 | B6RQS2 | 1797 |
| *Quercus alba* (White oak) | *Que a* 1.0401 | No | Pathogenesis-related protein, PR-10, *Bet v* 1 family member | ABZ81047 | B6RQS3 | 1798 |
| *Ricinus communis* (Castor bean) | *Ric c* 1 | Yes | 2S albumin | CAA38097 | P01089 | 1799 |
| *Rubus idaeus* (Red raspberry) | *Rub i* 1 | Yes | Pathogenesis-related protein, PR-10, *Bet v* 1 family member | ABG54495 | Q0Z8U9 | 1800 |
| *Rubus idaeus* (Red raspberry) | *Rub i* 3 | Yes | Non-specific lipid transfer protein 1 (nsLTP1) | ABG54494 | Q0Z8V0 | 1801 |
| *Salsola kali* (Russian thistle, Saltwort) | *Sal k* 1.0101 | No | Pectin methylesterase | P83181 | P83181 | 1802 |
| *Salsola kali* (Russian thistle, Saltwort) | *Sal k* 1.0201 | No | Pectinesterase | AAT99258 | I6LD58 | 1803 |
| *Salsola kali* (Russian thistle, Saltwort) | *Sal k* 1.0301 | No | Pectinesterase | AAX11262 | Q17ST3 | 1804 |
| *Salsola kali* (Russian thistle, Saltwort) | *Sal k* 1.0302 | No | Pectinesterase | AAX11261 | Q17ST4 | 1805 |
| *Salsola kali* (Russian thistle, Saltwort) | *Sal k* 2 | No | Protein kinase homologue | AAN05083 | Q8L5K9 | 1806 |
| *Salsola kali* (Russian thistle, Saltwort) | *Sal k* 3 | No | Cobalamin independent methionine synthase | ACO34814 | C1KEU0 | 1807 |
| *Salsola kali* (Russian thistle, Saltwort) | *Sal k* 4.0101 | No | Profilin | ACS34771 | C6JWH0 | 1808 |
| *Salsola kali* (Russian thistle, Saltwort) | *Sal k* 4.0201 | No | Profilin | ADK22841 | E2D0Y9 | 1809 |
| *Salsola kali* (Russian thistle, Saltwort) | *Sal k* 5 | No | Ole e 1-like protein | ADK22842 | E2D0Z0 | 1810 |
| *Sesamum indicum* (Sesame) | *Ses i* 1 | Yes | 2S albumin | AAK15088 | Q9AUD1 | 1811 |
| *Sesamum indicum* (Sesame) | *Ses i* 2 | Yes | 2S seed storage protein 1 | AAD42943 | Q9XHP1 | 1812 |
| *Sesamum indicum* (Sesame) | *Ses i* 3 | Yes | 7S vicilin-like globulin | AAK15089 | Q9AUD0 | 1813 |
| *Sesamum indicum* (Sesame) | *Ses i* 4 | Yes | oleosin | AAG23840 | Q9FUJ9 | 1814 |
| *Sesamum indicum* (Sesame) | *Ses i* 5 | Yes | oleosin | AAD42942 | Q9XHP2 | 1815 |
| *Sesamum indicum* (Sesame) | *Ses i* 6 | Yes | 11S globulin seed storage protein 2 | AAD42944 | Q9XHP0 | 1816 |
| *Sesamum indicum* (Sesame) | *Ses i* 7 | Yes | 11S globulin | AAK15087 | Q9AUD2 | 1817 |
| *Sinapis alba* (Yellow mustard) | *Sin a* 1 | Yes | 2S albumin | CAA62909 | P15322 | 1818 |
| *Sinapis alba* (Yellow mustard) | *Sin a* 2 | Yes | 11S globulin (legumin-like) seed storage protein | AAX77383 | Q2TLW0 | 1819 |
| *Sinapis alba* (Yellow mustard) | *Sin a* 3 | Yes | non-specific lipid transfer protein type 1 | ABU95411 | E6Y2L9 | 1820 |
| *Sinapis alba* (Yellow mustard) | *Sin a* 4 | Yes | Profilin | ABU95412 | E6Y2M0 | 1821 |
| *Solanum lycopersicum* (*Lycopersicon esculentum*) (Tomato) | *Sola l* 1 | Yes | Profilin-2 | CAD10377 | Q93YG7 | 1822 |
| *Solanum lycopersicum* (*Lycopersicon esculentum*) (Tomato) | *Sola l* 2.0101 | Yes | Beta-fructofuranosidase | AAL75449 | Q547Q0 | 1823 |
| *Solanum lycopersicum* (*Lycopersicon esculentum*) (Tomato) | *Sola l* 2.0201 | Yes | Beta-fructofuranosidase | AAL75450 | Q8RVW4 | 1824 |
| *Solanum lycopersicum* (*Lycopersicon esculentum*) (Tomato) | *Sola l* 3 | Yes | Non-specific lipid-transfer protein 2 | AAB42069 | P93224 | 1825 |

TABLE 5-continued

Allergen proteins

| Species | Allergen | Food Allergen | Biochemical name | GenBank | Uniprot | SEQ ID NO |
|---|---|---|---|---|---|---|
| *Solanum lycopersicum* (*Lycopersicon esculentum*) (Tomato) | *Sola l* 4.0101 | Yes | Pathogenesis-related protein, PR-10, *Bet v* 1 family member, TSI-1 | AHC08073 | K4CWC5 | 1826 |
| *Solanum lycopersicum* (*Lycopersicon esculentum*) (Tomato) | *Sola l* 4.0201 | Yes | Pathogenesis-related protein, PR-10, *Bet v* 1 family member, TSI-1 | NP_001275580 | K4CWC4 | 1827 |
| *Solanum lycopersicum* (*Lycopersicon esculentum*) (Tomato) | *Sola l* 5 | Yes | Cyclophilin (Peptidyl-prolyl cis-trans isomerase) | AAA63543 | P21568 | 1828 |
| *Solanum lycopersicum* (*Lycopersicon esculentum*) (Tomato) | *Sola l* 6 | Yes | Non-specific lipid transfer protein type 2 (nsLTP2) | XP_004232333 | K4BBD9 | 1829 |
| *Solanum lycopersicum* (*Lycopersicon esculentum*) (Tomato) | *Sola l* 7 | Yes | nsLTP type 1 | / | / | / |
| *Solanum tuberosum* (Potato) | *Sola t* 1 | Yes | Patatin | CAA31576 | P15476 | 1830 |
| *Solanum tuberosum* (Potato) | *Sola t* 2 | Yes | Cathepsin D inhibitor PDI | P16348 | P16348 | 1831 |
| *Solanum tuberosum* (Potato) | *Sola t* 3.0101 | Yes | Cysteine protease inhibitor 10 | AAB63099 | O24383 | 1832 |
| *Solanum tuberosum* (Potato) | *Sola t* 3.0102 | Yes | Cysteine protease inhibitor 1 | AAA33845 | P20347 | 1833 |
| *Solanum tuberosum* (Potato) | *Sola t* 4 | Yes | Serine protease inhibitor 7 | BAA04149 | P30941 | 1834 |
| *Syringa vulgaris* (Lilac) | *Syr v* 1.0102 | No | Ole e 1-related protein, isoform 2 | S43243 | / | 1835 |
| *Syringa vulgaris* (Lilac) | *Syr v* 1.0103 | No | Ole e 1-related protein, isoform 3 | S43244 | / | 1836 |
| *Syringa vulgaris* (Lilac) | *Syr v* 3 | No | Polcalcin | AAK01144 | P58171 | 1837 |
| *Triplochiton scleroxylon* (Obeche) | *Trip s* 1 | No | Endochitinase | / | C0HJM6 | 1838 |
| *Vigna radiata* (Mung bean) | *Vig r* 1 | Yes | Pathogenesis-related protein, PR-10, *Bet v* 1 family member | AAX19889 | Q2VU97 | 1839 |
| *Vigna radiata* (Mung bean) | *Vig r* 2.0101 | Yes | 8S Globulin (Vicilin), beta isoform | ABG02262 | Q198W3 | 1840 |
| *Vigna radiata* (Mung bean) | *Vig r* 2.0201 | Yes | 8S globulin alpha subunit | ABW23574 | B1NPN8 | 1841 |
| *Vigna radiata* (Mung bean) | *Vig r* 4 | Yes | Seed albumin | CAA50008 | Q43680 | 1842 |
| *Vigna radiata* (Mung bean) | *Vig r* 6 | Yes | Cytokinin-specific binding protein (CSBP), *Bet v* 1 family member | BAA74451 | Q9ZWP8 | 1843 |
| *Vitis vinifera* (Grape) | *Vit v* 1 | Yes | Non-specific lipid transfer protein 1 (nsLTP1) | AAO33394 | Q850K5 | 1844 |
| *Ziziphus mauritiana* (Chinese-date) | *Ziz m* 1 | Yes | Class III chitinase | AAX40948 | Q2VST0 | 1845 |
| Plantae Pinopsida | | | | | | |
| *Chamaecyparis obtusa* (Japanese cypress) | *Cha o* 1 | No | Pectate lyase | BAA08246 | Q96385 | 1846 |
| *Chamaecyparis obtusa* (Japanese cypress) | *Cha o* 2 | No | Polygalacturonase | Q7M1E7 | Q7M1E7 | 1847 |
| *Chamaecyparis obtusa* (Japanese cypress) | *Cha o* 3 | No | Cellulase (glycosyl hydrolase) | / | / | / |
| *Cryptomeria japonica* (Sugi) | *Cry j* 1.0101 | No | Pectate lyase | BAA05542 | P18632 | 1848 |
| *Cryptomeria japonica* (Sugi) | *Cry j* 1.0103 | No | Pectate lyase | BAB86286 | Q8RUR1 | 1849 |
| *Cryptomeria japonica* (Sugi) | *Cry j* 2 | No | Polygalacturonase | / | / | / |
| *Cupressus arizonica* (Cypress) | *Cup a* 1 | No | Pectate lyase | BAA06172 | P43212 | 1850 |
| *Cupressus sempervirens* (Common cypress) | *Cup s* 1.0101 | No | Pectate lyase | AAF72625 | Q9M4S6 | 1851 |
| *Cupressus sempervirens* (Common cypress) | *Cup s* 1.0102 | No | Pectate lyase | AAF72626 | Q9M4S5 | 1852 |
| *Cupressus sempervirens* (Common cypress) | *Cup s* 1.0103 | No | Pectate lyase | AAF72627 | Q9M4S4 | 1853 |

TABLE 5-continued

Allergen proteins

| Species | Allergen | Food Allergen | Biochemical name | GenBank | Uniprot | SEQ ID NO |
|---|---|---|---|---|---|---|
| *Cupressus sempervirens* (Common cypress) | Cup s 1.0104 | No | Pectate lyase | AAF72628 | Q9M4S3 | 1854 |
| *Cupressus sempervirens* (Common cypress) | Cup s 1.0105 | No | Pectate lyase | AAF72629 | Q9M4S2 | 1855 |
| *Cupressus sempervirens* (Common cypress) | Cup s 2 | No | Polygalacturonase | / | C0HKB1 | 1856 |
| *Cupressus sempervirens* (Common cypress) | Cup s 3.0101 | No | Thaumatin-like protein | AAR21073 | Q69CS2 | 1857 |
| *Cupressus sempervirens* (Common cypress) | Cup s 3.0102 | No | Thaumatin-like protein | AAR21074 | Q69CS3 | 1858 |
| *Juniperus ashei* (Mountain cedar) | Jun a 1.010101 | No | Pectate lyase | AAD03608 | P81294 | 1859 |
| *Juniperus ashei* (Mountain cedar) | Jun a 1.010102 | No | Pectate lyase | AAD03609 | P81294 | 1859 |
| *Juniperus ashei* (Mountain cedar) | Jun a 2 | No | Polygalacturonase | CAC05582 | Q9FY19 | 1860 |
| *Juniperus ashei* (Mountain cedar) | Jun a 3 | No | Thaumatin-like protein | AAF31759 | P81295 | 1861 |
| *Juniperus oxycedrus* (Prickly juniper) | Jun o 4 | No | Polcalcin-like protein (4 EF hand domains) | AAC15474 | O64943 | 1862 |
| *Juniperus sabinoides* (Mountain cedar) | Jun s 1 | No | / | / | / | / |
| *Juniperus virginiana* (Eastern red cedar) | Jun v 1.0101 | No | Pectate lyase-1 | AAF80166 | Q9LLT2 | 1863 |
| *Juniperus virginiana* (Eastern red cedar) | Jun v 1.0102 | No | Pectate lyase-1 | AAF80164 | Q9LLT1 | 1863 |
| *Juniperus virginiana* (Eastern red cedar) | Jun v 3 | No | Thaumatin-like protein | AAF80167 | Q9LD79 | 1864 |
| *Pinus koraiensis* (Korean Pine) | Pin k 2 | No | Vicilin | AHC94918 | V9VGU0 | 1865 |
| *Pinus pinea* (Stone pine) | Pin p 1 | No | 2S albumin | CTQ87571.1 | / | 1866 |

In some embodiments, SPNs, magnetic particle conjugates and compositions of the present invention may detect a specific epitope of a target allergen. As used herein, an "epitope" is the part of the allergen that is recognized by the immune system (e.g., antibodies. B cells, or T cells). Generally, the whole allergen is not involved in the immune response, but rather, the epitopes of allergens, which are recognized by a T-cell receptor or an IgE-antibody, contribute to allergic reactions. SPNs, magnetic particle conjugates and compositions of the present invention may bind to an epitope of a target allergen in a similar manner as antibodies or T-cell receptors.

Epitopes of an allergen protein may be identified using methods and techniques known in the art. For example, IgE-binding epitopes may be determined by methods such as X-ray co-crystallography of allergens and immunocomplexes, array-based oligo-peptide scanning, mutagenesis mapping, or nuclear magnetic resonance. For example, T-cell epitopes may be identified using short peptide fragments that overlap the entire amino acid sequence of the target allergen and allergen-specific T-cell lines derived from peripheral blood mononuclear cells. Peptides that induce T-cell proliferation contain T-cell epitopes. Additional techniques that may be used to determine epitopes on an allergen protein include crosslinking coupled mass spectrometry, hydrogen-deuterium exchange, and computer-based in silico analysis. Many epitopes of common food allergens have been identified, such as those listed in Tables 1-5 of Matsuo H et al., *Allergol Int.* 2015 October; 64(4):332-43.

In some embodiments, SPNs, magnetic particle conjugates and compositions of the present invention may be used in a hospital for clinical food allergy or allergy test and to identify food/allergen(s) to which a patient is allergic. In addition, SPNs, magnetic particle conjugates and compositions of the present invention may be used as a carry-on tester for people who have food/environmental allergy, for example at home to test commercial food, or at restaurant to check dishes they ordered. The food sample could be fresh food, frozen food, cooled food or processed food containing animal derived meat and/or vegetables.

In some embodiments, SPNs, magnetic particle conjugates and compositions of the present invention may detect other target molecules, including but not limited to, pathogens from a pathogenic microorganism in a sample, such as bacteria, yeasts, fungi, spores, viruses or prions; disease proteins (e.g., biomarkers for diseases diagnosis and prognosis); pesticides and fertilizers remained in the environment; and toxins. In other embodiments, SPNs and compositions of the present invention may bind to non-protein targets such as minerals and small molecules (e.g., antibiotics), drugs and inorganic ion.

II. Kits, Packaging and Biosensors

Compositions, SPNs, SPN-complement complexes, magnetic particle conjugates, DNA-printed solid substrates and detection agents of the present invention may be combined with other ingredients or reagents or prepared as components of kits or other retail products for commercial sale or distribution.

The kit will contain compositions of the present invention, along with instructions regarding administration and/or use of the kit. The kit may also contain one or more of the following: a syringe, a bag or bottle.

Formulations and/or compositions of the present invention can be packaged for use in a variety of pharmaceutically or diagnostically acceptable containers using any acceptable container closure, as the formulations are compatible with PVC-containing and PVC-free containers and container closures. Examples of acceptable containers include, but are not limited to, ampules and pre-filled syringes, cartridges and the like.

Alternatively, the formulation may contain SPNs, SPN-complement complexes, magnetic particle conjugates in one compartment of an admix bag and an acceptable solvent in a separate compartment of the admix bag such that the two compartments may be mixed together prior to use. Acceptable containers are well known in the art and commercially available.

In some embodiments, biosensors comprising compositions, SPN-complement complexes, magnetic particle conjugates, DNA-printed solid substrates and detection agents of the present invention are provided. The biosensor may be an on-chip magnetic particle biosensor. For example, a plurality of magnetic particle sensors are embedded in the integrated circuit; the magnetic particle sensors are capable of detecting magnetic particles specifically bound to the one or more sensor areas on the surface of the integrated circuit. The affinity molecules on the surface of the sensor area may be SPNs, or SPN-complement complexes of the present invention.

In some embodiments, a graphene-oxide (GO) based biosensor is provided, wherein the sensing agents are SPNs conjugated to the graphene-oxide surface.

In some aspects, it may be a "signal on" biosensor. The SPN and its complementary sequence may be labeled with a fluorophore and a quencher at one end of the nucleic acid sequence, respectively. The signal produced by the sensor is dependent on the structural changes in the SPNs following the binding of target allergens. The binding of the target allergen to the SPN disrupts the SPN-complement complex and replaces the complementary sequence in the complex, resulting in the quenched fluorescent signal back on (FIG. 4B).

In some aspects, it may be a "signal off" biosensor, in which the complementary sequence is labeled with a fluorophore at one end of the sequence. The binding of the target allergen to the SPN detaches the complementary sequence in the complex, causing the fluorescent signal off (FIG. 4A).

In other aspects, it may be a "dual signal" biosensor, in which the SPN and the complementary sequence are labeled with different fluorophores. The competition between the target allergen and the complement will change the fluorescent signals (FIG. 4C).

III. Detection Methods and Assays

In accordance with the present invention, aptamers, SPNs and SPN-complement complexes, magnetic particle conjugates, DNA-printed solid substrates, detection agents and compositions of the present invention may be used to, in a broad concept, detect any molecules in a sample in a large variety of applications, such as food safety, diagnostic and prognostic tests in civilian and battlefield settings, environmental monitoring/control, and military use for detection of biological weapons. Various methods and assays may be used in combination with aptamers, SPNs, SPN-complement complexes, magnetic particle conjugates, DNA-printed solid substrates, detection agents and compositions of the present invention, the choice may depend on the application field.

Particularly the present invention provides methods of determining the absence, presence and/or quantity of one or more target allergens in a sample using detection agents comprising SPN-magnetic particle conjugates and printed solid substrates. In some embodiments, the detection assays and methods can be used in a hospital for clinical food allergy or allergy test and to identify food/allergen(s) to which a patient is allergic. Such assays and methods may be used to monitor allergen contamination in food industry. Additionally, they may also be used at home or in a restaurant by a person who has allergy to test the allergen content before he/she consumes the food.

Examples of foods are eggs, milk, meat, fishes, crustacea and mollusks, cereals, legumes and nuts, fruits, vegetables, beer yeast, and gelatin; more particularly, egg white and egg yolk of the eggs, milk and cheese of the milk, pork, beef, chicken and mutton of the meat, mackerel, horse mackerel, sardine, tuna, salmon, codfish, flatfish and salmon caviar of the fishes, crab, shrimp, blue mussel, squid, octopus, lobster and abalone of the crustacea and mollusks, wheat, rice, buckwheat, rye, barley, oat, corn, millet, foxtail millet and barnyardgrass of the cereals, soybean, peanut, cacao, pea, kidney bean, hazelnut, Brazil nut, almond, coconut and walnut of the legumes and nuts, apple, banana, orange, peach, kiwi, strawberry, melon, avocado, grapefruit, mango, pear, sesame and mustard of the fruits, tomato, carrot, potato, spinach, onion, garlic, bamboo shoot, pumpkin, sweet potato, celery, parsley, yam and Matsutake mushroom of the vegetables, the foods containing them, and the ingredients thereof (e.g., ovoalbumin, ovomucoid, lysozyme, casein, beta-lactoglobulin, alpha-lactoalbumin, gluten, and alpha-amylase inhibitor).

The foods could be fresh foods, frozen foods, cooled foods or processed foods containing animal derived meat and/or vegetables. These foods may be processed by heating, freezing, drying, salting, fermentation, enzymatic processing, etc.

In some embodiments, more than one agents may be used, depending on the nature of the food matrixes. Some food contains several allergenic proteins, e.g., at least eight peanut proteins, such as Ara h1 and Ara h2, can potentially cause an immunological response. In such case, more than one SPNs against more than one allergenic protein may be used in a mixed cocktail for detecting the absence or presence of peanut. In other aspects, some food matrixes such as fish, shellfish and mollusks, contain only one major allergenic protein. One or more SPNs that specifically bind to this major allergen protein may be used for allergen detection.

In some embodiments, allergen detection assays and methods of the present invention can detect a lower concentration of allergen in a food sample. The sensitivity of nucleic acid aptamers makes it possible to detect the presence of an allergen as low as 0.0001 ppm. In some aspects, the concentration or mass of allergen that can be detected may range from 0.001 ppm to 5 ppm, or from 0.001 ppm to 0.1 ppm, or from 0.1 ppm to 3 ppm, or from 1 ppm to 5 ppm, or from 5 ppm to 10 ppm, or from 10 ppm to 50 ppm, or from 10 ppm to 20 ppm, or from 10 ppm to 100 ppm. In some aspects, the concentration or mass of allergen in a food sample that can be detected may be 0.001 ppm, 0.002 ppm, 0.003 ppm, 0.004 ppm, 0.005 ppm, 0.006 ppm, 0.007 ppm, 0.008 ppm, 0.009 ppm, 0.01 ppm, 0.02 ppm, 0.03 ppm, 0.04 ppm, 0.05 ppm, 0.06 ppm, 0.07 ppm, 0.08 ppm, 0.09 ppm, 0.1 ppm, 0.2 ppm, 0.3 ppm, 0.4 ppm, 0.5 ppm, 0.6 ppm, 0.7 ppm, 0.8 ppm, 0.9 ppm, 1.0 ppm, 1.5 ppm, 2 ppm, 2.5 ppm, 3 ppm, 3.5 ppm, 4 ppm, 4.5 ppm, 5 ppm or 10 ppm. In some embodiments, the concentration or mass of allergen in a food sample that can be detected may be 5 ppm, 1 ppm, 15 ppm, 20 ppm, 25 ppm, 30 ppm, 35 ppm, 40 ppm, 45 ppm, 50 ppm, 55 ppm, 60 ppm, 65 ppm, 70 ppm, 75 ppm, 80 ppm, 85 ppm, 90 ppm, 95 ppm or 100 ppm. In one embodiment, the concentration or mass of allergen in a food sample that can be detected may be at low as 50 ppm. In another embodiment, the concentration or mass of allergen in a food sample that can be detected may be at low as 12.5 ppm In accordance with the present aptamer derived SPN based detection assays, the sensitivity can be achieved regardless of food matrices. The diverse food matrices with different salt, fat and sugar content, different color, texture, and pH can be detected at the present sensitivity.

In some embodiments, methods of the present invention for detecting the absence, presence and/or quantity of a target allergen in a test sample comprise (a). obtaining and processing a test sample which is suspected to contain an allergen of interest; (b). contacting the processed test sample with detection agents comprising SPNs conjugated to solid substrates, wherein the SPNs are single-stranded nucleic acid molecules having 20 to 200 nucleotides capable of specifically binding to the target allergen; (c) washing the mixture of the detection agents and the test sample formed in step (b); (d). detecting the allergen-SPN complexes formed during the assay; and (e). processing and analyzing the detection signals to determine whether the target allergen is present in the food sample and/or the quantity of the target allergen in the sample.

In some aspects, the detection agents further comprise a nucleic acid molecule complementary to a region of the SPN sequence which binds to the SPN only when the SPN is not bound to its target allergen protein; the SPN and the complementary sequence forms the SPN-complement complex, in which the SPN and the complementary sequence work as binding ligand (to the target allergen) and detection molecule or label, respectively. In some examples, the SPN is covalently immobilized on the surface of the solid substrate through its 5'end or 3'end. In other examples, the complementary sequence is covalently immobilized on the surface of the solid substrate.

In some examples, the solid substrate is magnetic particles. In accordance, the magnetic particles may be held using a magnetic field during the wash step. Optionally, the washed reaction mixture may be shaken, prior to detecting the allergen-SPN-magnetic particle complexes formed during the assay.

Assays and methods of the present invention may have various forms depending on biosensors, detection kits and detection devices and systems used to implement the assays. SPN/complement-magnetic particle conjugates may be used in any steps of the assays, such as capture agents to capture a target analyte (e.g., a target allergen or a specific epitope of the target allergen) in a sample; or detector agents for signaling detection; or competitive binding agents, or affinity agents to selected a target analyte (e.g., an allergen) bound magnetic particles.

In some embodiments, SPNs comprise the nucleic acid sequences of SEQ ID NOs.: 1-696 (See Tables 1-4). The complementary sequences may contain about 5-20 nucleotide residues. The SPN and its complementary sequence may be at a ratio of 1:5, or at a ratio of 1:4, or at a ratio of 1:3, or at a ratio of 1:2.

In some embodiments, an attachment assay may be developed using the compositions and agents of the present invention (as shown in FIG. 6A). Accordingly, the assay may comprise steps of (a). obtaining and processing a test sample which is suspected to contain an allergen of interest; (b). contacting the processed sample with signaling polynucleotides (SPNs) which specifically bind to the allergen of interest, wherein the SPNs are labeled with a fluorophore at one end of the sequence; (c). exposing the mixture of the processed sample and the SPNs formed in step (b) to the surface of a solid substrate, wherein the surface of the solid substrate comprises nucleic acid sequences that are complementary to a region of the SPN sequence; (d). washing the mixture formed in step (c); (e). detecting a fluorescent signal from the surface of the solid substrate; and (f). processing and analyzing the fluorescent signal to determine the absence, presence, and/or the quantity of the allergen of interest in the test sample. The free SPNs which are not bound to the allergen proteins will bind to the complementary sequences printed on the solid surface and will contribute to the fluorescence reading, while the SPNs which are bound to the allergen proteins will not attach to the solid surface and will be washed away. The fluorescence reading will indicate the absence, presence or quantity of the allergen of interest in the test sample.

In other embodiments, a detachment assay may be developed using the compositions and agents of the present invention (as shown in FIG. 6B). Accordingly, the assay may comprise steps of (a) obtaining and processing a test sample which is suspected to contain an allergen of interest; (b) exposing the processed sample to the surface of a solid substrate, wherein the surface of the solid substrate comprises SPN-complement complexes which specifically bind the allergen of interest; (c) washing the mixture formed in step (b); (d) detecting a fluorescent signal from the surface of the solid substrate and comparing the fluorescent signal to that detected prior to the exposure of the processed sample; and (e) processing and analyzing the fluorescent signal to determine the absence, presence, and/or the quantity of the allergen of interest in the test sample. In accordance with this detachment assay, the SPN complementary sequences are printed to the surface of the solid substrate. The SPNs which specifically bind to the allergen of interest are incubated with the surface. The mixture will be washed and a fluorescence reading is recorded. The allergen proteins in the test sample, when added to the SPN-complement complexes, will bind to the SPNs and the SPN-protein complexes detach from the complementary sequences and will be washed away. The fluorescence reading from step (d) is compared with the preread fluorescence signal; the difference may be used for determining the absence, presence or quantity of the allergen of interest in the test sample.

In some embodiments, SPNs with different sequences but having a high affinity and specificity to the same target allergen may be used in combination. In other aspects, SPNs of the present invention may be used in combination with antibodies that bind the same target allergen in a detection assay.

In some embodiments, the detection assay of the present invention can be optimized depending on the testing condition such as food matrix. The reaction buffer used may be decreased in volume. In some aspects. The reaction volume can be limited to less than 5 mL, for example, less than 4 mL, or less than 3 mL, or less than 2 mL, or less than 1 mL.

In one example, the volume may be 1.5 mL, 2 mL, 2.5 mL, 3 mL, 3.5 mL, 4.5 mL, and 5.0 mL.

In some embodiments, the sample size can be reduced, limiting the requirement of a large size sample. The assay sensitivity can be achieved with a small portion of test sample, for example, less than 5 mg, or less than 4.5 mg, or less than 4 mg, or less than 3.5 mg, or less than 3 mg, or less than 2.5 mg, or less than 2 mg, or less than 1.5 mg.

In some embodiments, the detection assay of the present invention can be completed in a short period of time, for example less than 5 minutes. In some aspects, the detection reaction can be completed from 10 seconds to 5 minutes, or from 10 seconds to 60 seconds, or from 1 minute to 2 minutes. In some examples, the detection assay can be completed in about 10 seconds, about 20 seconds, about 30 seconds, about 35 seconds, about 40 seconds, about 45 seconds, about 50 seconds, about 1 minute, about 1.5 minutes, about 2 minutes, about 2.5 minutes, about 3 minutes, about 4.5 minutes, or about 5 minutes.

In some embodiments, the detection assays of the present invention can be optimized to achieve the greatest signal intensity. The step optimization may include, but are not limited to, changing the concentration of SPN molecules, controlling the sample and SPN incubation conditions and time, controlling the flow rate and maximizing the exposure of solid surface to SPNs.

In some embodiments, the detection assay of the present invention further comprising an internal control signal. The built-in control signal may be measured using pre-incubated free SPNs and/or free food samples without SPN binding. These control signals will reduce the background signal and non-specific reading during the detection reaction.

In some embodiments, the detection signals are processed and displayed by a reader device. The reader device may be a computer, an iPad and/or a cellphone, or other processors that can execute one or more methods for detecting the absence, presence and/or quantity of the target allergen.

In accordance with the present invention, the detection agents and other reaction agents of the detection assay are stable and can be stored for a long-period of time. In general, short nucleic acid molecules are stable at routine storage condition. In some aspects, the SPNs, SPN-magnetic bead conjugates and nucleic acid coated solid surfaces are stable and can maintain their activity for at least one month, or at least two months, or at least three months, or at least four months, or at least five months, or at least six months. They may be stable from about one month to about one year. The reaction agents such as the extraction buffer can be stable at various temperature for at least nine months, or at least ten months, or at least one year.

IV. Definitions

At various places in the present specification, substituents of compounds of the present disclosure are disclosed in groups or in ranges. It is specifically intended that the present disclosure include each and every individual sub-combination of the members of such groups and ranges. The following is a non-limiting list of term definitions.

Activity: As used herein, the term "activity" refers to the condition in which things are happening or being done. Compositions of the invention may have activity and this activity may involve the binding to a target molecule.

Allergen: as used herein, the term "allergen" means a compound, substance or composition that causes, elicits or triggers and immune reaction in a subject. As such, allergens are typically referred to as antigens. An allergen is typically a protein or a polypeptide.

Allergen detection agent: As used herein, the term "an allergen detection agent" refers to Any agent which is capable of, or does, interact with and/or bind to one or more allergens in a way that allows detection of such allergen in a sample is referred to herein as an "allergen detection agent" or "detection agent".

Analyte: As used herein, an "analyte" is a target of interest that can specifically interact with (bind to) an aptamer and be detected and/or measured. In the context of the present invention, an analyte may be an allergen.

Aptamer: as used herein, the term "aptamer" refers to single stranded nucleic acid. In general, aptamers refer to either an oligonucleotide of a single defined sequence or a mixture of said oligonucleotides, wherein the mixture retains the properties of binding specifically to a target allergen. A RNA aptamer is an aptamer comprising ribonucleoside units. RNA aptamer also meant to encompass RNA analogs as defined herein. A DNA aptamer an aptamer comprising deoxy-ribonucleoside units. DNA aptamer also meant to encompass DNA analogs as defined herein.

Binding affinity: as used herein, the term "binding affinity" is intended to refer to the tendency of an aptamer to bind or not bind a target and describes the measure of the strength of the binding or affinity of the aptamer to bind the target.

Complementary: As used herein, the term "complementary" or "complement" refer to the natural binding of polynucleotides by base pairing such as A-T(U) and C-G pairs. Two single-stranded molecules may be partially complementary such that only some of the nucleic acids bind, or it may be "complete," such that total complementarity exists between the single stranded molecules. The degree of complementarity between nucleic acid strands has significant effects on the efficiency and strength of the hybridization between the nucleic acid strands.

Detection: As used herein, the term "detection" means an extraction of a particular target protein from a mixture of many non-target proteins, indicating the absence, presence, and/or amount of a target protein from a mixture of many non-target proteins.

Hybridization: As used herein, the term "hybridization" refers to the process by which a polynucleotide strand anneals with a complementary strand through base pairing under defined hybridization conditions. Specific hybridization is an indication that two nucleic acid sequences share a high degree of identity such as a SPN of the present invention and a short complementary sequence of the SPN. Specific hybridization complexes form under permissive annealing conditions and remain hybridized after the "washing" step(s). The washing step(s) is particularly important in determining the stringency of the hybridization process, with more stringent conditions allowing less non-specific binding. i.e., binding between pairs of nucleic acid strands that are not perfectly matched.

Magnetic particles: As used herein, the term "magnetic particles" refer to ( ). Magnetic particles may include magnetic microbeads and/or nanoparticles.

Oligonucleotide: as used herein, the term "oligonucleotide" is generic to polydeoxyribonucleotides (containing 2'-deoxy-D-ribose or modified forms thereof), i.e. DNA, to polyribonucleotides (containing D ribose or modified forms thereof), i.e. RNA, and to any other type of polynucleotide which is an N-glycoside or C-glycoside of a purine or pyrimidine base, or modified purine or pyrimidine base or abasic nucleotides. In the context of the present invention, the "oligonucleotide" includes not only those with conventional bases, sugar residues and internucleotide linkages, but also those that contain modifications of any or all of these three moieties.

As used herein, the terms "nucleic acid" "polynucleotide" and "oligonucleotide" are used interchangeable herein and refer to a deoxyribonucleotide or ribonucleotide polymer in either single- or double-stranded form, and unless otherwise limited, encompasses known analogs of natural nucleotides that hybridize to nucleic acids in a manner similar to naturally-occurring nucleotides. Examples of such analogs include, without limitation, phosphorothioates, phosphoramidates, methyl phosphonates, chiral-methyl phosphonates, 2-O-methyl ribonucleotides, and peptide-nucleic acids (PNAs).

Sample: As used herein, the term "sample" refers to any composition that might contain a target of interest to be analyzed including, but not limited to, biological samples obtained from subjects (including humans and animals as detailed below), samples obtained from the environment for example soil samples, water samples, agriculture samples (including plant and crop samples), or food samples. Food samples may be obtained from fresh food, processed/cooked food or frozen food.

Sensitivity: As used herein, the term "sensitivity" means the ability of a detection molecule to bind to a target molecule.

Specifically binds: as used herein, the term "specifically binds" means that an aptamer reacts or associates more frequently, more rapidly, with greater duration and with greater affinity with a particular target molecule, than it does with alternative target molecules. For example, an aptamer that specifically binds to a target allergen binds that allergen or a structural part or fragment thereof with greater affinity, avidity, more readily, and/or with greater duration than it binds to unrelated allergen protein and/or parts or fragments thereof. It is also understood by reading this definition that, for example, an aptamer that specifically binds to a first target may or may not specifically bind to a second target. As such, "specific binding" does not necessarily require exclusive binding or non-detectable binding of another molecule, this is encompassed by the term "selective binding". The specificity of binding is defined in terms of the comparative dissociation constants (Kd) of the aptamer for target as compared to the dissociation constant with respect to the aptamer and other materials in the environment or unrelated molecules in general. Typically, the Kd for the aptamer with respect to the target will be 2-fold, 5-fold, or 10-fold less than the Kd with respect to the target and the unrelated molecule or accompanying molecule in the environment. Even more preferably, the Kd will be 50-fold, 100-fold or 200-fold less.

Target: as used herein, the term "target" and "target molecule" refers to a molecule which may be found in a tested sample and which is capable of binding to a detection molecule such as an aptamer or an antibody.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production, any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

EXAMPLES

Example 1: Conjugating Aptamers (Specific to Peanut Allergen Ara H1) to Magnetic Beads An aptamer against the Ara h 1 allergen protein which is described by Tran et al. in *Selection of aptamers against Ara h 1 protein for FO-SPR biosensing of peanut allergens in food matrices*. Biosensors and Bioelectronics, 2013, 43, 245-251 (incorporated herein by reference in its entirety), was used to design a signaling polynucleotide and conjugated to magnetic beads. The sequence of this aptamer is shown below (SEQ ID NO: 96).

5'TCGCACATTCCGCTTCTACCGGGGGTCGAGCT-
GAGTGGATGCGAA
TCTGTGGGTGGGCCGTAAGTCCGTGTGTGCGAA3'
(SEQ ID NO.: 96)

A short nucleic acid sequence containing 5 nucleotide residues was designed to be complementary to the 3'-end residues of the T-modified aptamer of SEQ ID NO: 96. Alternatively, the sequence may be complementary to the 5'-end residues of the T-modified aptamer of SEQ ID NO: 96. One end of the complementary sequence was labeled with a fluorophore, Texas Red.

Figure 1B:
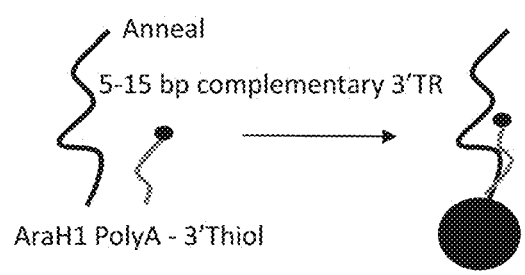

Three reactions were used to conjugate the aptamer to magnetic beads. The sequence was modified with a thiol (—SH) modifier at either the 5'end or 3'end (FIG. 1A and FIG. 1B). Magnetic beads were then linked to the 5'end (as shown in FIG. 1A) or to the 3'end (as shown in FIG. 1B) of the aptamer through covalent bonds. In particular, the thiol-modified aptamer, including 5'thiol and 3'thiol, was linked to magnetic beads by maleimide linkage. The Texas Red labeled complementary sequence was annealed to form a double stranded hybrid at the other end of the aptamer conjugated to magnetic beads, generating a magnetic bead conjugated signaling polynucleotide (SPN) (See FIG. 1A and FIG. 1B).

Figure 1C:
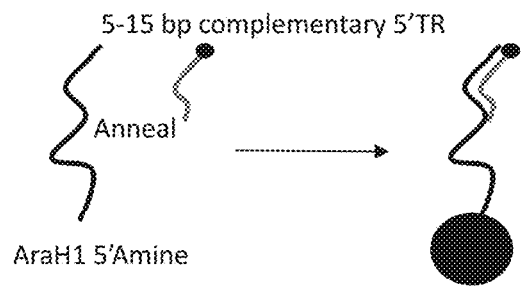

Alternatively, the aptamer was modified with a primary amine group at the 5'end or 3'end. The amine modified aptamer was attached to magnetic beads via carbodiimide chemical reaction. Magnetic carboxylated speedbeads were used (GE Healthcare Life Science, Cat. Log No.: XX). The Texas Red labeled complementary sequence was annealed to the aptamer at the 3'end, forming a magnetic bead conjugated signaling polynucleotide (SPN) (shown in FIG. 1C). Alternatively, the 5-nt complementary sequence was labeled with either Cy5 or Alex647 at one end (5'end or 3'end).

Amine Reaction

Amine-modified DNA molecules at either 5' end of 3' end were coupled to magnetic carboxylated speedbeads (GE Healthcare, USA) through carbodiimide chemical reaction. Carboxyl modified beads were first incubated with EDC/NHS (N-hydroxysuccinimide) prior to the addition of amine-modified DNA molecules. After EDC/NHS reaction, the carboxyl groups (—COOH) were activated for direct reaction with primary amines via amide bond formation. Amine-modified DNA molecules were mixed with the beads and the coupling reaction of beads and DNA occurred in water. After the reaction, a TRIS buffer was used to block/occupy the unreacted sites.

Thiol Reaction

Thiol-modified DNA molecules at either 5' end of 3' end were coupled to magnetic carboxylated speedbeads (GE Healthcare. USA) through amino-polyethylene-glycol maleimide linkage (2HN-PEG-Maleimide). The carboxyl groups (—COOH) on the surface of beads were activated first using water soluble EDC (1-ethyl-3-(~3-dimethylaminopropyl) carbodiimide hydrochloride) and then by 2-HN-methoxy-polyethylene glycol (PEG). The beads were incubated with EDC and PEGs in MES (4-morpholinoethanesulfonic acid) reaction buffer for 2 hours (30 min×4 sonicator bath). Activated beads were then mixed with thiol-modified DNA molecules and incubated with DTT (Dithiothreitol) in water.

Example 2: Reading of Fluorescence Signaling for Magnetic Beads Conjugated SPN in Detection of a Target Molecule The study tested an experimental procedure for obtaining fluorescence readings and thereby determining the effectiveness of signaling polynucleotides in identifying and quantifying a molecular target such as an allergen protein in a food sample.

Figure 2A:
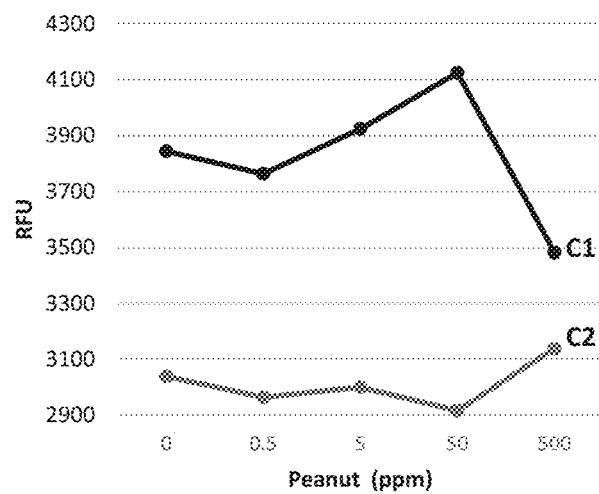
FIG. 2A is a representative fluorescent signal measurement of the 5'thiol modification. C1 indicates the complementary sequence is 15 nucleotides in length, while C2 indicates that the complementary sequence is 10 nucleotides in length.
Figure 2B:
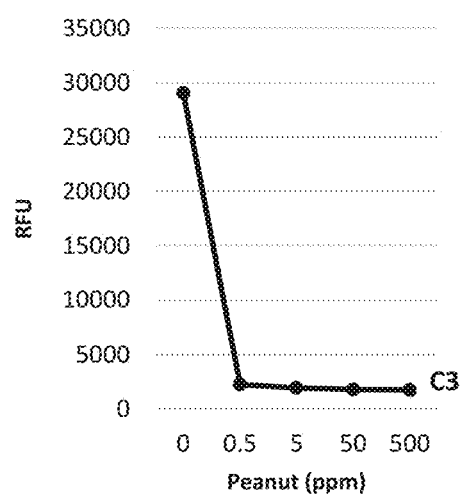
FIG. 2B and FIG. 2C are representative signals of the 5' thiol modification. C3 indicates that the complementary sequence includes 5 complementary nucleotides and 5nt polyA.
Figure 2C:
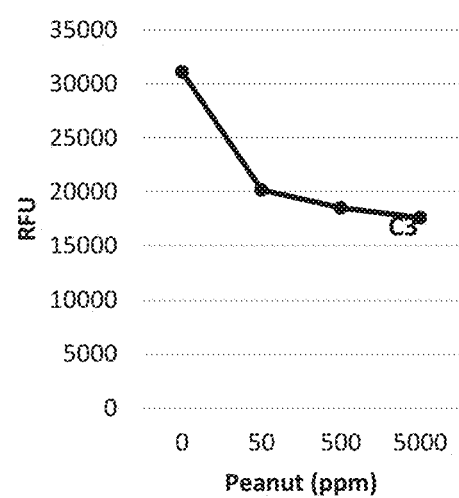

Peanut was diluted to an appropriate concentration in double-distilled water, ranging from 0 ppm to 500 ppm. SPN-magnetic bead conjugates as described in Example 1 were diluted in solution/buffer either HEPES/Tween, PBS/BSA or T-buffer (Tris pH8 100 mM NaCl, 50 mM KCl, 10 mM MgCl 0.5% Sodium Deoxcholate 0.1% Gelatin 1% Triton 0.1% SDS) at various concentrations. Peanut samples and SPN-magnetic bead conjugates were mixed and incubated for a period of time. The fluorescent signals before and after the reaction were detected and measured. In one study in which magnetic beads and SPN-complement were configured as illustrated in FIG. 1A, the fluorescent signals from Texas Red dye was decreased after the allergen binding (shown in FIGS. 2A to 2C). The relative fluorescent unit (RFU) indicates that Texas Red signal is dropped off after the peanut allergen target binds the SPN in a concentration dependent manner. It also shows that the complementary sequence could affect the signal decrease. As seen in FIGS. 2A and 2B, the complementary sequence could affect the signaling quencher after the binding of the target allergen. The sequence comprising 5 complementary nucleotides and 5nt polyA displayed a significantly fluorescence off (92% decrease) (C3 in FIG. 2B), while the sequence comprising 15 (C1 in FIG. 2A) or 10 (C2 in FIG. 2A) complementary nucleotides displays a moderate signal decrease.

Figure 3:
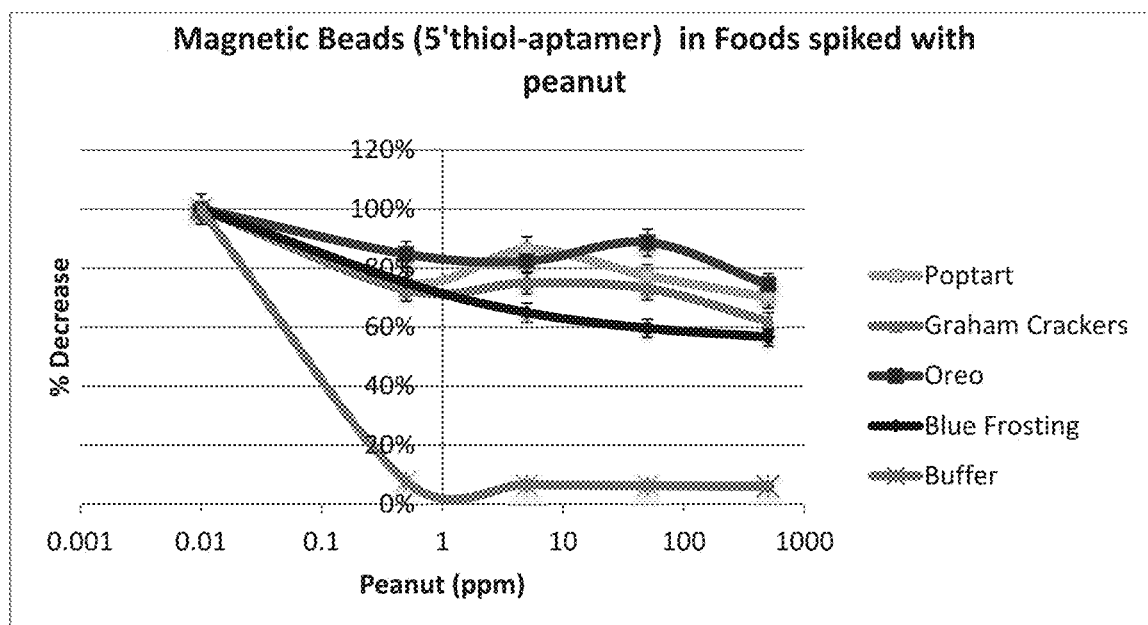
FIG. 3 is a diagram showing fluorescence signal off using magnetic beads conjugated with 5'thiol modified Ara H aptamer in foods spiked with different concentrations of peanut.

Food samples spiked with peanut including Poptart, Graham crackers, Oreo, Blue Frosting were tested for signal decrease using 5'thiol modified SPN conjugated magnetic beads. As illustrated in FIG. 3 and FIG. 4, 5' thiol modification displays significant fluorescent signal decrease in all foods tested and at different concentrations of target allergen, peanut (FIG. 3).

Comparison of signal detection using magnetic beads conjugated with 5'thiol modified SPNs and magnetic beads conjugated with polyA3'thiol modified SPNs suggest that 5'thiol modification displays more significant decrease than polyA3'thiol modification (See Table 6). About 40% of signal decrease was detected with magnetic beads conjugated with 5'thiol modified SPNs, while only about 20% of signal decrease was detected with magnetic beads conjugated with polyA3'thiol modified SPNs. The fluorescent measure also indicates that thiol modification displays more significant decrease than amine modification (data not shown).

TABLE 6

Fluorescent signal measure (RFU) (5'thiol v. 3'polyA thiol)

| | Peanut (ppm) | | | | |
|---|---|---|---|---|---|
| | 0.0 | 0.5 | 5 | 50 | 500 |
| Magnetic beads with 5'thiol modified aptamers | | | | | |
| 100 nM | 19394.5 | 12896.9 | 9233.6 | 9376.4 | 8885.3 |
| 1 µM | 34037.8 | 33582.8 | 32449.6 | 31283.4 | 30118.7 |
| 2.5 µM | 36535.8 | 34252.9 | 33767.1 | 33926.5 | 32535 |
| Magnetic beads with PolyA 3'thiol modified aptamers | | | | | |
| 100 nM | 18888.4 | 15053.6 | 15249.9 | 15554.5 | 15387.1 |
| 1 µM | 25213.2 | 25691.6 | 25303.1 | 24456.2 | 24404.7 |
| 2.5 µM | 36515.3 | 34852.5 | 34342.5 | 32904 | 34064.1 |

Example 3: Amine-SPN Conjugates

As described in Example 1, amine-modified SPNs were annealed with the 5-nt complementary sequences (at a ratio of 1:5). The SPN-complement complex was conjugated to magnetic beads. The complementary sequence was labeled with Cy5 or Alex647, respectively. The SPN-magnetic bead conjugates were incubated with different concentrations of peanut flour (from 0 ppm to 500 ppm) at 37° C. Fluorescent signals were recorded after the incubation. As shown in Table 7, both dyes display significant signal decreases as peanut concentration increases, indicating more allergen proteins bind the SPN and detach the complementary sequences from the SPNs.

TABLE 7

Amine-SPN with peanut

| | Peanut | | | | |
|---|---|---|---|---|---|
| SPN | 0 ppm | 0.5 ppm | 5 ppm | 50 ppm | 500 ppm |
| Alex647 | | | | | |
| 500 nM | 9026 | 11617 | 11211 | 13074 | 10112 |
| 2.5 nM | 22583 | 17662 | 21953 | 21380 | 18007 |
| Cy5 | | | | | |
| 500 nM | 8102 | 6600 | 7762 | 9364 | 7431 |
| 5 nM | 40595 | 39622 | 38021 | 32525 | 30101 |

Example 4: Thiol-SPN Conjugates

As described in Example 1, thiol-modified oligonucleotides were annealed with the 5-nt complementary sequences (at a ratio of 1:5). The SPN-complement complexes were conjugated to magnetic beads. The complementary sequence was labeled with Cy5 or Alex647, respectively. The SPN-magnetic bead conjugates were incubated with different concentrations of peanut flour (from 0 ppm to 500 ppm) at 37° C. Fluorescent signals were recorded after the incubation. As shown in Table 8, both dyes display significant signal decreases as peanut concentration increases, indicating more allergen proteins bind the SPN and detach the complementary sequences from the SPNs. As shown in Table 8, when the SPN is at high concentration, 1000 nM, Cy5 labeled signal decreases as the peanut concentration increases.

TABLE 8

Thiol-SPN with peanut

| | Peanut | | | | |
|---|---|---|---|---|---|
| SPN | 0 ppm | 0.5 ppm | 5 ppm | 50 ppm | 500 ppm |
| Alex647 | | | | | |
| 500 nM | 14806.8 | 15377.6 | 15231.7 | 14362.7 | 15001.6 |
| 1000 nM | 35980.7 | 37720.1 | 36920 | 34901.3 | 36660.1 |
| Cy5 | | | | | |
| 500 nM | 20692.3 | 20838.9 | 27197.2 | 28255.5 | 27519.7 |
| 1000 nM | 28789.8 | 28290.8 | 20019.6 | 20162.1 | 19975 |

Example 5: Examining the Effect of Washing Step and Reaction Conditions on Signal Detection Various parameters may affect the stability of nucleic acids immobilized on magnetic beads and their interaction with target allergens in a test sample. Tables 9 and 10 illustrate the fluorescent reading in various conditions tested. The data suggests that doubling Maleimide concentration enables signal decrease using a higher concentration of SPN. However the decrease doesn't retain more than 50% (Table 9). Shaking the SPN solution prior to the signal reading to re-suspend magnetic beads is critical for accurate signal measurement. It can cause about 65% decrease in signal (Table 10). The data also suggests that the step of washing beads after reaction, extraction buffer and annealing conditions affect the signal detection (Table 10).

TABLE 9

Fluorescent signal measure (RFU) (2XMaleimide/40 mg)
Magnetic beads with 5'thiol modified aptamers

| | Peanut (ppm) | | | |
|---|---|---|---|---|
| | 0.0 | 5 | 50 | 500 |
| 100 nM | 30786.4 | 15740.5 | 17604.1 | 17452.1 |
| 1 μM | 27295.6 | 20574 | 15591.3 | 15271.4 |
| 5 μM | 47497.8 | 43324.9 | 42758.1 | 38351.5 |

TABLE 10

Fluorescent signal measure (RFU)
Magnetic beads with 5'thiol modified aptamers

| | Peanut (ppm) | | | | |
|---|---|---|---|---|---|
| | 0.0 | 0.5 | 5 | 50 | 500 |
| Extraction buffer; shaken before read | 6152.8 | 4635 | 5170 | 5713 | 5304.5 |
| PBS with BSA; shaken before read | 30504.5 | 10861.3 | 7620.5 | 6253.7 | 7037 |
| Exaction buffer; not shaken | 7051 | 5584.5 | 7660.8 | 6642.8 | 7567.3 |
| PBS with BSA; not shaken | 8966 | 7685.8 | 8983 | 7269 | 9062.3 |

Effect of Wash Components on Signal Detection

Reaction mixtures comprising polyA-thiol modified SPNs and peanuts were washed before signal detection using PBS buffer containing BSA (Bovine serum albumin). As compared with the signal after washing with PBS only, noticeable signal decrease is detected as peanut concentration is increased, indicating that BSA can facilitate removal of the complementary sequences after allergen binding (Table 11).

TABLE 11

BSA effect on signal detection

Peanut diluted in PBS/BSA

| | SPN | | | |
|---|---|---|---|---|
| peanut | 500 nM (Alex647) | 2.5 nM (Alex647) | 500 nM (Cy5) | 2.5 nM (Cy5) |
| 0 ppm | 16,692 | 18587 | 14458 | 33500 |
| 5 ppm | 16832 | 18078 | 13304 | 34606 |
| 500 ppm | 16731 | 17841 | 12874 | 37788 |

Peanut diluted in PBS only (no BSA)

| | SPN | | | |
|---|---|---|---|---|
| | 500 nM (Alex647) | 2.5 nM (Alex647) | 500 nM (Cy5) | 2.5 nM (Cy5) |
| 0 ppm | 19953.9 | 21356.3 | 13589.4 | 39577.4 |
| 5 ppm | 16865.6 | 19508 | 14558.3 | 41638.4 |
| 500 ppm | 16135.1 | 17034 | 12959.4 | 33267.1 |

Washing Buffer Containing Detergent

SPN-complement complexes with Texas Red, complementary sequences labeled with Texas red, and fluorophore Texas Red alone were washed with PBS buffer containing Tween-20 at various concentrations. The fluorescent signals (RFU) after washing were detected and compared.

TABLE 12 signal (RFU) after PBS/Tween-20 washing

| | Amine-SPN/complement | Complement alone | Texas red |
|---|---|---|---|
| PBS only | 13425.4 | 5554.9 | 1778.8 |
| PBS plus 0.05% Tween | 11249.8 | 5133.5 | 1581.3 |
| PBS plus 0.1% Tween | 5683 | 2342.9 | 903 |

Example 6: Ratio of Oligonucleotides and Complementary Sequences

As shown in Examples 3 and 4, the high ratio 1:5 of aptamer oligonucleotides and complementary sequences gives a high fluorescent signal. A ratio 1:2 of aptamer oligonucleotides and complementary sequences was tested for signal detection.

TABLE 13

SPN: complementary sequence at a ratio of 1:2

| SPN | Alex647 | Cy5 |
|---|---|---|
| 100 nM | 2167.5 | 1809.9 |
| 500 nM | 14967 | 10499.3 |
| 1 μM | 29429.2 | 23651.2 |
| 2.5 μM | 30386.4 | 30418.5 |
| 5 μM | 21663.9 | 39843.3 |

Magnetic beads conjugated with complexes of amine-SPN and its complementary sequences labeled with Cy5 in which the amine-SPN molecules and CY-5-labeled complementary sequences is at a ratio of 1:2, were incubated with peanut flour at concentrations from 0 to 500 ppm. Signals were detected and as shown in Table 14, signal decreases as peanut concentration increases.

TABLE 14

Signal detection with peanut flour

Amine-SPN and complementary sequence labeled with Cy5

| peanut | 10 μl Magnetic bead conjugates | 20 μl magnetic bead conjugates |
|---|---|---|
| 0 ppm | 23703.4 | 38756.8 |
| 0.5 ppm | 27125.8 | 38830 |
| 5 ppm | 26329.7 | 38264.1 |
| 50 ppm | 25576.2 | 36271 |
| 500 ppm | 19263.4 | 33445.4 |
| 2500 ppm | 8798.1 | 17685.8 |

Example 7: Magnetic Beads Absorbance

To test if the same amount of beads are analyzed during target detection, the absorbance signals were analyzed in parallel with the fluorescent signal. Magnetic beads conjugated with SPN-complement complexes of amine-SPN and its complementary sequence (5nt in length) labeled with Cy5 in which the amine-SPN molecules and CY-5-labeled complementary sequences is at a ratio of 1:2, were incubated with peanut flour at concentrations from 0 to 500 ppm. Absorbance by beads was measured. The absorbance data indicates a change in absorbance when magnetic beaded conjugated to SPNs are exposed to higher concentrations of peanut flour (See Table 15).

TABLE 15

Absorbance by beads with amine-SPNs

| | Peanut | | | | |
|---|---|---|---|---|---|
| Amine-SPN | 0 ppm | 0.5 ppm | 5 ppm | 50 ppm | 500 ppm |
| 50 nM | 454.3 | 443.2 | 438.5 | 405.6 | 385.9 |
| 250 nM | 13796.8 | 14562.2 | 15624.6 | 13546.4 | 10750.2 |
| 500 nM | 30671.6 | 33112.6 | 33363.3 | 31182 | 25944.6 |

Similarly, magnetic beads conjugated with SPN-complement complexes of thiol-SPN and its complementary sequence (10 nt in length) labeled with Texas red in which the amine-SPN molecules and Texas red-labeled complementary sequences is at a ratio of 1:2, were incubated with peanut flour at concentrations from 0 to 500 ppm. Absorbance by beads was measured. As shown in Table 16, the absorption data indicates no changes in absorbance with beads conjugated to thiol-SPNs.

TABLE 16

Absorbance by beads with thioL-SPNs

| | Peanut | | | | |
|---|---|---|---|---|---|
| Thiol-SPN | 0 ppm | 0.5 ppm | 5 ppm | 50 ppm | 500 ppm |
| 250 nM | 12357.8 | 12397.8 | 12087.6 | 11863.2 | 10599.2 |
| 500 nM | 35442 | 36624 | 35181.6 | 36071.2 | 32547.8 |

Example 8: DNA Printing on the Surface of Glass Slides

Optimize the Printing Protocol 3 complementary sequences ranging in length between 10-15 nucleotides with a 3'amine modification are used for the test. The DNA sequences are attached and printed on the surface of the glass slides using a variety of DNA loading densities and slide coatings.

Screen for Complementary Sequences for a Selected Aptamer

A microarray-based screen is used to select complementary DNA sequences that only bind the aptamer when it is not bound to the allergen protein. An aptamer (SEQ ID NO. 353 and SEQ ID NO. 307) specific to peanut allergen protein AraH1 and an aptamer (SEQ ID NO. 564) specific to nut were selected. About 40 short sequences that are complementary to different portions of each aptamer are designed based on the aptamer sequence (See Table 17). These sequences range in length between 10-20 nucleotides. The short sequences (also referred to as anchor or linker sequences) are printed on the surface of the glass slide using the printing protocol optimized previously.

TABLE 17

| | | Short complementary sequences | | | |
|---|---|---|---|---|---|
| | SEQ ID NO. | Complement (5'-3') | | SEQ ID NO. | Complement (5'-3') |
| AraH1 | 96 | TCGCACATTCCGCTTCTACC GGGGGGGTCGAGCTGAGTGG ATGCGAATCTGTGGGTGGGC CGTAAGTCCGTGTGTGCGAA | P10 | 307 | TAGGGAAGAGAAGGACATATG ATGTCAGTCGATGGATGTGGT TGTGCTCGTCTTGACTAGTAC ATGACCACTT |
| A_1 | 697 | TTCGCACACA | P_1 | 739 | AAGTGGTCAT |
| A_2 | 698 | ACACACGGAC | P_2 | 740 | GTCATGTACT |
| A_3 | 699 | CGGACTTACG | P_3 | 741 | GTACTAGTCA |
| A_4 | 700 | TTACGGCCCA | P_4 | 742 | AGTCAAGACG |
| A_5 | 701 | GCCCACCCAC | P_5 | 743 | AGACGAGCAC |
| A_6 | 702 | CCCACAGATT | P_6 | 744 | AGCACAACCC |
| A_7 | 703 | AGATTCGCAT | P_7 | 745 | AACCCACATC |
| A_8 | 704 | CGCATCCACT | P_8 | 746 | ACATCCATCG |
| A_9 | 705 | CCACTCAGCT | P_9 | 747 | CATCGACTGA |
| A_10 | 706 | CAGCTCGACC | P_10 | 748 | ACTGACATCA |
| A_11 | 707 | CGACCCCCCC | P_11 | 749 | CATCATATGT |
| A_12 | 708 | CCCCCGGTAG | P_12 | 750 | TATGTCCTTC |
| A_13 | 709 | GGTAGAAGCG | P_13 | 751 | CCTTCTCTTC |
| A_14 | 710 | AAGCGGAATG | P_14 | 752 | TCTTCCCTA |
| A_15 | 711 | GAATGTGCGA | P_15 | 753 | AAGTGGTCATGTACT |
| A_16 | 712 | TTCGCACACACGGAC | P_16 | 754 | GTCATGTACTAGTCA |
| A_17 | 713 | ACACACGGACTTACG | P_17 | 755 | GTACTAGTCAAGACG |
| A_18 | 714 | CGGACTTACGGCCCA | P_18 | 756 | AGTCAAGACGAGCAC |
| A_19 | 715 | TTACGGCCCACCCAC | P_19 | 757 | AGACGAGCACAACCC |
| A_20 | 716 | GCCCACCCACAGATT | P_20 | 758 | AGCACAACCCACATC |
| A_21 | 717 | CCCACAGATTCGCAT | P_21 | 759 | AACCCACATCCATCG |
| A_22 | 718 | AGATTCGCATCCAT | P_22 | 760 | ACATCCATCGACTGA |
| A_23 | 719 | CGCATCCACTCAGCT | P_23 | 761 | CATCGACTGACATCA |
| A_24 | 720 | CCACTCAGCTCGACC | P_24 | 762 | ACTGACATCATATGT |
| A_25 | 721 | CAGCTCGACCCCCCC | P_25 | 763 | CATCATATGTCCTTC |
| A_26 | 722 | CGACCCCCCCGGTAG | P_26 | 764 | TATGTCCTTCTCTTC |
| A_27 | 723 | CCCCCGGTAGAAGCG | P_27 | 765 | CCTTCTCTTCCCTA |
| A_28 | 724 | GGTAGAAGCGGAATG | P_28 | 766 | AAGTGGTCATGTACTAGTCA |
| A_29 | 725 | AAGCGGAATGTGCGA | P_29 | 767 | GTCATGTACTAGTCAAGACG |
| A_30 | 726 | TTCGC ACACGGACTTACG | P_30 | 768 | GTACTAGTCAAGACGAGAC |
| A_31 | 727 | ACACACGGACTTACGGCCCA | P_31 | 769 | AGTCAAGACGAGCACAACCC |
| A_32 | 728 | CGGACTTACGGCCCACCCAC | P_32 | 770 | AGACGAGCACAACCCACATC |
| A_33 | 729 | TTACGGCCCACCCACAGATT | P_33 | 771 | AGCACAACCCACATCCATCG |
| A_34 | 730 | GCCCACCCACAGATTCGCAT | P_34 | 772 | AACCCACATCCATCGACTGA |
| A_35 | 731 | CCCACAGATTCGCATCCACT | P_35 | 773 | ACATCCATCGACTGACATCA |
| A_36 | 732 | AGATTCGCATCCACTCAGCT | P_36 | 774 | CATCGACTGACATCATATGT |

TABLE 17-continued

Short complementary sequences

| SEQ ID NO. | Complement (5'-3') | | SEQ ID NO. | Complement (5'-3') |
|---|---|---|---|---|
| A_37 | 733 | CGCATCCACTCAGCTCGACC | P_37 | 775 | ACTGACATCATATGTCCTTC |
| A_38 | 734 | CCACTCAGCTCGACCCCCCC | P_38 | 776 | CATCATATGTCCTTC TCTTC |
| A_39 | 735 | CAGCTCGACCCCCCCGGTAG | P_39 | 777 | TATGTCCTTCTCTTCCCTA |
| A_40 | 736 | CGACCCCCCCGGTAGAAGCG | P_40 | | |
| A_41 | 737 | CCCCCGGTAGAAGCGGAATG | P_41 | | |
| A_42 | 738 | GGTAGAAGCGGAATGTGCGA | P_42 | | |

Each of 16-array slides is coated with 3 copies of the 50 sequences, giving a total of 150 sequences per array (see chip layout in Table 18) using the printing protocol optimized previously. The binding of the short sequences to its target aptamer is tested using either an attachment or detachment protocol detailed below. The aptamer is labeled on the 5' end with a fluorescent dye Cy5 which is used to quantify the aptamer bound to the plate. The allergenic protein is prepared into a serial dilution of five different concentrations (e.g., 0 ppm, 1 ppm, 10 ppm, 100 ppm, and 1000 ppm). The output of the experiment is relative Cy5 reads from the protein curve as well as the negative controls. Table 17 shows an example of the screen chip layout. The screen consists of three 16-array slides. Each array is designed to have 3 copies of the 50 sequences (150 samples total). For each experimental slide, a 5-point protein curve (×3) and a buffer control are included (a full 16 array slide).

TABLE 18

Screen chip layout

| Slide No. | Treatment | Slide setup |
|---|---|---|
| 1 | Attachment protocol (triplicates) | 0 ppm 1 ppm 10 ppm 100 ppm 1000 ppm<br>0 ppm 1 ppm 10 ppm 100 ppm 1000 ppm<br>0 ppm 1 ppm 10 ppm 100 ppm 1000 ppm  buffer |
| 2 | Detachment protocol (triplicates) | 0 ppm 1 ppm 10 ppm 100 ppm 1000 ppm<br>0 ppm 1 ppm 10 ppm 100 ppm 1000 ppm<br>0 ppm 1 ppm 10 ppm 100 ppm 1000 ppm  buffer |
| 3 | Controls (duplicates) | 0 ppm 1 ppm 10 ppm 100 ppm 1000 ppm<br>0 ppm 1 ppm 10 ppm 100 ppm 1000 ppm<br>buffer buffer aptamer aptamer aptamer aptamer |

Attachment Assay

For the attachment protocol, a fixed concentration of aptamer is mixed with increasing concentrations of the allergen protein for 1 min to allow the aptamer to bind to the allergen protein. The protein-aptamer mixture is then added to the wells of the plate and incubated for 1 min at room temperature, washed, and measured for fluorescence. The controls for the experiment include determining fluorescence of the microarray wells with either only the aptamer or protein not previously incubated with the aptamer, as well as fluorescence with only the short sequences present. Aptamer that is protein-free attaches to the short sequences immobilized on the plate and contributes to the fluorescence reading. Protein-bound aptamer does not attach to the plate and is washed away. If the short immobilized DNA sequence only binds the protein-free aptamer, decreasing fluorescence signal is observed with an increasing concentration of the protein, as the higher the protein concentration the less protein-free aptamer is available to bind to the short sequence on the microarray. If the short sequence cannot differentiate between protein-bound and unbound aptamer, a similar fluorescence intensity is observed regardless of the concentration of the protein.

Detachment Assay

For the detachment protocol, the aptamer is added to the wells of the plate and incubated for 1 min at room temperature, washed, and measured for fluorescence. Protein is added to the plate at five different concentrations, incubated for 1 min, washed, and measured for fluorescence again. The controls of the experiment are the same as described for the attachment protocol. If the short sequence only binds the protein-free aptamer, a drop in fluorescence signal is observed when protein is added. The magnitude of the drop increases with an increasing concentration of the protein, as the higher the protein concentration the more aptamers detach from the short immobilized sequence. If the short sequence cannot differentiate between protein-bound and unbound aptamer, a similar fluorescence intensity is observed regardless of the concentration of the protein.

The top 3 short sequences are selected based on the screen results and validated using a second microarray. Each one of the 3 sequences is printed in 50 spots per array, giving a total of 150 sequences. The binding to the short sequences is tested using either an attachment or detachment protocol as described above. The validation assay incorporates control proteins and control test matrices (see chip layout in Table 18). Relative Cy5 reads from different protein concentrations as well as the negative controls are compared. The best candidate meets the following criteria: (a) specific binding to the corresponding aptamer, (b) easy detachment from the bound aptamer in the presence of the allergenic protein, and (c) minimal background/non-specific binding. The selected complementary sequence is used to form SPN-complement complexes.

Table 19 shows the chip layout for the validation assay. A set of 12, 16-array slides are used for the attachment assay and another 12 are used for the detachment assay. For each slide, a 5-point curve (×3) and a control are included (a full 16 array slide). Each spot of the 16 array slides contains 50 copies of the 3 candidates selected from the screen (150 samples total).

TABLE 19

Validation Chip layout

| Slide No. | Category | Slide setup |
|---|---|---|
| 1 | Test | protein curve + aptamer in buffer |
| 2 | Test | protein curve + aptamer in food 1 |
| 3 | Test | protein curve + aptamer in food 2 |
| 4 | Test | protein curve + aptamer in food 3 |
| 5 | Control | control protein + aptamer curve 1 |
| 6 | Control | control protein + aptamer curve 2 |
| 7 | Control | control protein + aptamer curve 3 |
| 8 | Control | aptamer, no protein |
| 9 | Control | no aptamer in buffer |
| 10 | Control | no aptamer in food 1 |
| 11 | Control | no aptamer in food 2 |
| 12 | Control | no aptamer in food 3 |

Example 9: Validation of Detection Sensitivity of SPN-Magnetic Beads Conjugates

As discussed in Example 1, 5' Thiol modified short complementary sequences were conjugated to magnetic beads and aptamer specific to peanut allergen (SEQ ID NO. 96: 5' (Texas Red) TCGCACATTCCGCTTC-TACCGGGGGGTCGAGCTGAGTG-GATGCGAATCTGTGGG TGGGCCGTAAGTCCGTGTGTGCGAA3') was hybrided with the short linker nucleic acid molecules. The aptamer was labeled with Texas red at the 5' end. The short linker sequence is AAAAATCAAGTGGTC with 5' Thiol modification (SEQ ID NO. 778)

Figure 7A:
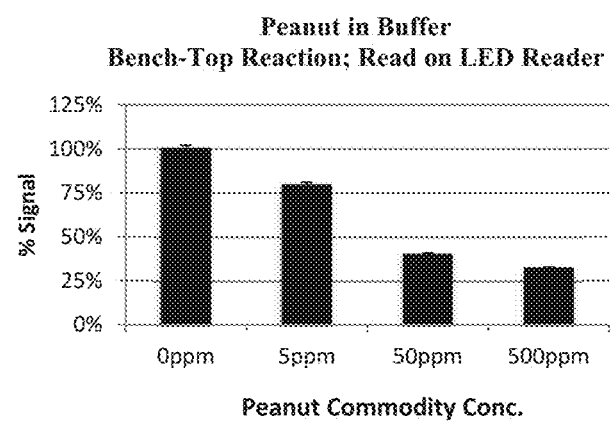
FIG. 7A is a representative histogram of detection of peanut diluted in buffer. Peanut specific SPNs are conjugated to magnetic beads and fluorescent signals are recorded using a lab grade LED based reader.
Figure 7B:
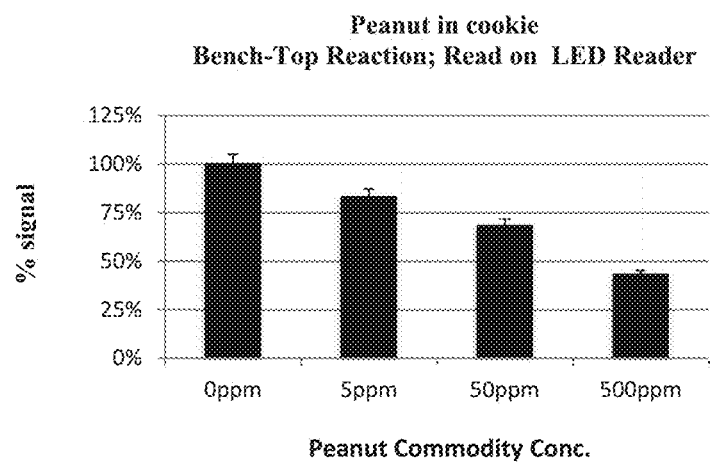
FIG. 7B is a representative histogram of detection of peanut spiked in cookie. Peanut specific SPNs are conjugated to magnetic beads and fluorescent signals are recorded using a lab grade LED based reader.
Figure 8A:
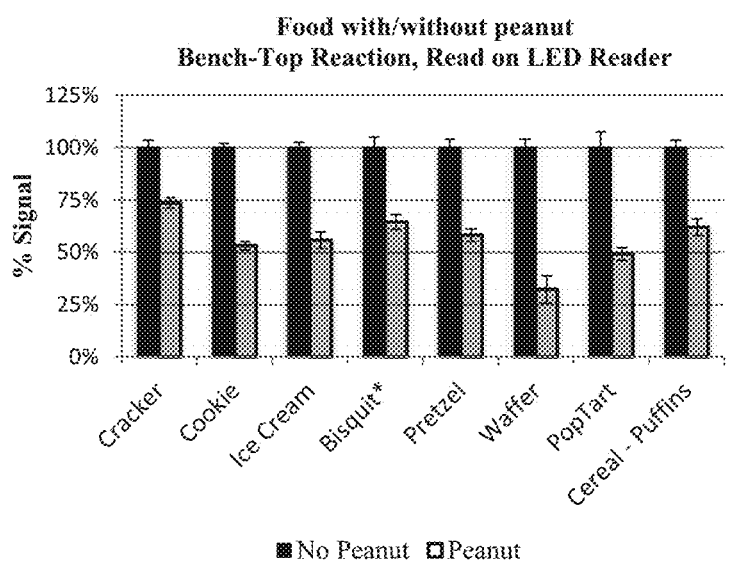
FIG. 8A is a representative histogram of signal reduction when comparing food samples with and without peanut. Peanut specific SPNs are conjugated to magnetic beads and fluorescent signals are recorded using a lab grade LED based e reader.
Figure 8B:
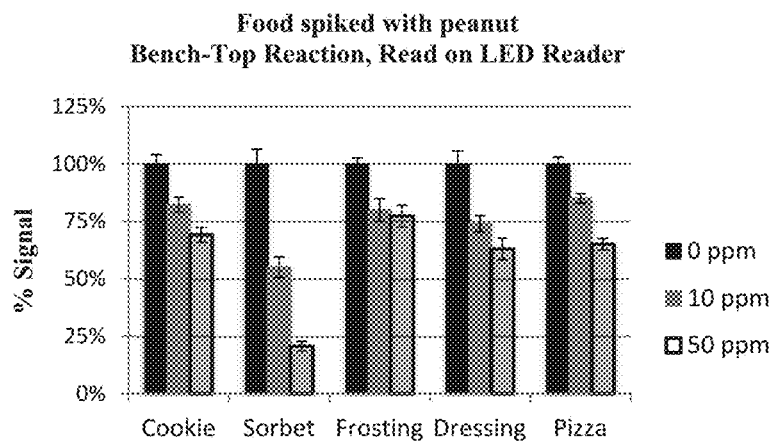
FIG. 8B is representative histogram showing signal reduction in 5 different food samples spiked with peanut at different concentrations. Peanut specific SPNs are conjugated to magnetic beads and fluorescent signals are recorded using a lab grade LED based reader.

The SPN-magnetic bead conjugates were used as detection agents to validate the detection sensitivity in detection assays. Peanut was diluted in either buffer or cookie at 0 ppm, 5 ppm, 50 ppm and 500 ppm, respectively. The prepared peanut samples were reacted with SPN-magnetic bead conjugates (loaded in 96-well microplate) and signals were read using lab-grade LED based reader after incubation and wash. Under bench-top reaction conditions, peanut present either in buffer or in cookie can be detected at a low ppm using SPN-magnetic bead conjugates. The recorded signal indicates that the fluorescent signal is correlatively reduced when the concentration of peanut increases. At the concentration of 50 ppm (peanut commodity), a significant fluorescent signal reduction is recorded in buffer (FIG. 7A) and cookie (FIG. 7B). This observation confirms the 50 ppm detection sensitivity as shown in previous assays. In a similar assay, when peanut was added to other food samples, a significant signal reduction is seen at 50 ppm peanut (FIG. 8B). Comparison of food samples with peanut and those containing no peanut, at least 25% of signal reduction is observed in all samples compared (FIG. 8A). Food samples were chose based on their general concerns with allergic concerns. For example, cookie, cereal, chocolate and ice cream are commonly consumed; Blue frosting is high food coloring; Pizza is highly processed food which is hard to detect the presence of allergens using available detection assays such as the ELISA assay; and Ranch dressing is high in fat. This selection covers a broad range of matrices. These observations suggest that assays using SPN-magnetic bead conjugates can achieve a 50 ppm sensitivity with all food matrices being tested.

In order to further confirm the sensitivity of the SPN-magnetic bead conjugates based assay, over 20 different food matrices were spiked with peanut and tested for signal detection and its sensitivity. The 50 ppm sensitivity was confirmed on representative foods from each category as shown in Table 20.

TABLE 20

The detection sensitivity of SPN-magnetic bead conjugates

| | | Fluorescent signal reduction | |
|---|---|---|---|
| Food category | Food | 0 ppm peanut | 50 ppm peanut |
| Baked goods | cookie | 100% | 71% |
| | Red Velvet Cake | 100% | 86% |
| | Oatmeal Cookie | 100% | 68% |
| | Waffer | 100% | 47% |
| Sauses, dressings and Marinades | Dressing | 100% | 67% |
| | salsa | 100% | 61% |
| | Tomato sauce | 100% | 81% |
| | Hummus | 100% | 77% |
| Entrees | Oatmeal | 100% | 73% |
| | Sausage | 100% | 67% |
| | Bread | 100% | 82% |
| | French Fries | 100% | 37% |
| | Pizza | 100% | 76% |
| | Chicken | 100% | 60% |
| Desserts | Vanilia Pudding | 100% | 68% |
| | Vanilla Oreo | 100% | 79% |
| | Meringue | 100% | 64% |
| | Blue Frosting | 100% | 64% |
| | Sorbet | 100% | 21% |
| | Ice Cream | 100% | 79% |
| | Blueberry Yogurt | 100% | 82% |
| | Grape Jelly | 100% | 41% |

The detection sensitivity of SPN-magnetic bead conjugates was further confirmed using different fluorescent signal readers. The signal reading was recorded and analyzed using a lab-grade LED based reader as well as a designed optical sensor. When the detection assay was carried out using Data shown in Table 21 indicate that the detection sensitivity is not affected when using different signal readers. The designed optical sensor is comparable to the laboratory-standard microplate reader (e.g., FIGS. 8A and 8B; and Table 20) and can differentiate between 0 ppm and 50 ppm peanut in food with 95% confidence.

TABLE 21

The detection sensitivity of SPN-magnetic bead conjugates

| | Fluorescent signal reduction | |
|---|---|---|
| Food | 0 ppm peanut | 50 ppm peanut |
| Cookie | 100% | 62% |
| Sorbert | 100% | 28% |
| Frosting | 100% | 72% |
| Dressing | 100% | 67% |
| Pizza | 100% | 72% |
| Cracker | 100% | 53% |
| Cookie | 100% | 65% |
| Ice cream | 100% | 65% |
| Biscuit | 100% | 62% |
| Pretzel | 100% | 57% |
| Waffer | 100% | 47% |
| Poptart | 100% | 45% |

Example 10: Detection Assays with Nucleic Acid Coated Chips

Chips were coated with short complementary DNA sequences that bind the aptamer only when it is not bound to the allergen protein. These short nucleic acid anchor sequences specific to the aptamers (SEQ ID NO. 307, SEQ ID NO. 404 and SEQ ID NO. 304) which bind to peanut allergen protein were used to coat the glass. These anchor sequences are about 10 nt in length. The short anchor sequences are further modified to contain 5 (polyA) at one end to pull the sequence away from the surface. A 6 carbon or 12 Carbon linker is further added to the sequences to pull them further away from the surface. An amine attachment is added to print the sequences to the surface of the chip. The sequences and modification of the anchor/linker DNA molecules are listed in Table 22. Prepared peanut containing samples were incubated with a fixed concentration of SPNs specific to the peanut allergen and filtered to remove unbound food particles. The aptamers were labeled with Cy5 at the 5' end. The mixture was incubated with the chip coated with short linker/anchor sequences. After incubation and wash, the fluorescent reading was recorded using a lab grade LED based reader, as well as the designed optical sensor. The anchor sequences that generate the most specific and sensitive signals are selected for further validation.

TABLE 22

Sequences used to coat the solid surface (chip) and their modifications

| Name | Sequence | Modification | SEQ ID NO. |
|---|---|---|---|
| AP_1 | /5AmMC6/TTCGCACACA | 5' 6CAmine | 697 |
| AP_2 | /5AmMC6/ACACACGGAC | 5' 6CAmine | 698 |
| AP_3 | /5AmMC6/CGGACTTACG | 5' 6CAmine | 699 |
| AP_4 | /5AmMC6/TTACGGCCCA | 5' 6CAmine | 700 |
| AP_5 | /5AmMC6/GCCCACCCAC | 5' 6CAmine | 701 |
| AP_6 | /5AmMC6/CCCACAGATT | 5' 6CAmine | 702 |
| AP_7 | /5AmMC6/AGATTCGCAT | 5' 6CAmine | 703 |
| AP_8 | /5AmMC6/CGCATCCACT | 5' 6CAmine | 733 |
| AP_9 | /5AmMC6/CCACTCAGCT | 5' 6CAmine | 705 |
| AP_10 | /5AmMC6/CAGCTCGACC | 5' 6CAmine | 706 |
| AP_11 | /5AmMC6/CGACCCCCCC | 5' 6CAmine | 707 |
| AP_12 | /5AmMC6/CCCCCGGTAG | 5' 6CAmine | 708 |
| AP_13 | /5AmMC6/GGTAGAAGCG | 5' 6CAmine | 709 |
| AP_14 | /5AmMC6/AAGCGGAATG | 5' 6CAmine | 710 |
| AP_15 | /5AmMC6/GAATGTGCGA | 5' 6CAmine | 711 |
| 3_1 | /5AmMC6/aaaaaTCAAGTGGTC | 5' 6CAmine | 778 |
| 3_2 | /5AmMC6/aaaaaTGGTCATGTA | 5' 6CAmine | 779 |
| 3_3 | /5AmMC6/aaaaaTGTACTAGT | 5' 6CAmine | 780 |
| 3_4 | /5AmMC6/aaaaaTACTAGTCAA | 5' 6CAmine | 781 |
| 5_1 | /5AmMC6/aaaaaATCAT ATGTC | 5' 6CAmine | 782 |
| 5_2 | /5AmMC6/aaaaaATGTCCTTCT | 5' 6CAmine | 783 |
| 5_3 | /5AmMC6/aaaaaCTTCTCTTCC | 5' 6CAmine | 784 |
| 5_4 | /5AmMC6/aaaaaCTCTTCCCTA | 5' 6CAmine | 785 |
| P1_10 | /5AmMC6/aaaaaCATCGACTGACA | 5' 6CAmine | 786 |
| P2_8 | /5AmMC6/aaaaaCCATCGATGC | 5' 6CAmine | 787 |
| P2_18 | /5AmMC6/aaaaaCTACACCCACATC | 5' 6CAmine | 788 |
| AP_1_PA | /5AmMC6/aaaaaTTCGCACACA | 5' 6CAmine | 789 |
| AP_2_PA | /5AmMC6/aaaaaACACACGGAC | 5' 6CAmine | 790 |
| AP_3_PA | /5AmMC6/aaaaaCGGACTTACG | 5' 6CAmine | 791 |
| AP_4_PA | /5AmMC6/aaaaaTTACGGCCCA | 5' 6CAmine | 792 |
| AP_5_PA | /5AmMC6/aaaaaGCCCACCCAC | 5' 6CAmine | 793 |

TABLE 22-continued

Sequences used to coat the solid surface (chip) and their modifications

| Name | Sequence | Modification | SEQ ID NO. |
|---|---|---|---|
| AP_6_PA | /5AmMC6/aaaaaCCCACAGATT | 5' 6CAmine | 794 |
| AP_7_PA | /5AmMC6/aaaaaAGATTCGCAT | 5' 6CAmine | 795 |
| AP_8_PA | /5AmMC6/aaaaaCGCATCCACT | 5' 6CAmine | 796 |
| AP_9_PA | /5AmMC6/aaaaaCCACTCAGCT | 5' 6CAmine | 797 |
| AP_10_PA | /5AmMC6/aaaaaCAGCTCGACC | 5' 6CAmine | 798 |
| AP_11_PA | /5AmMC6/aaaaaCGACCCCCCC | 5' 6CAmine | 799 |
| AP_12_PA | /5AmMC6/aaaaaCCCCCGGTAG | 5' 6CAmine | 800 |
| AP_13_PA | /5AmMC6/aaaaaGGTAGAAGCG | 5' 6CAmine | 801 |
| AP_14_PA | /5AmMC6/aaaaaAAGCGGAATG | 5' 6CAmine | 802 |
| AP_15_PA | /5AmMC6/aaaaaGAATGTGCGA | 5' 6CAmine | 803 |

Figure 9A:
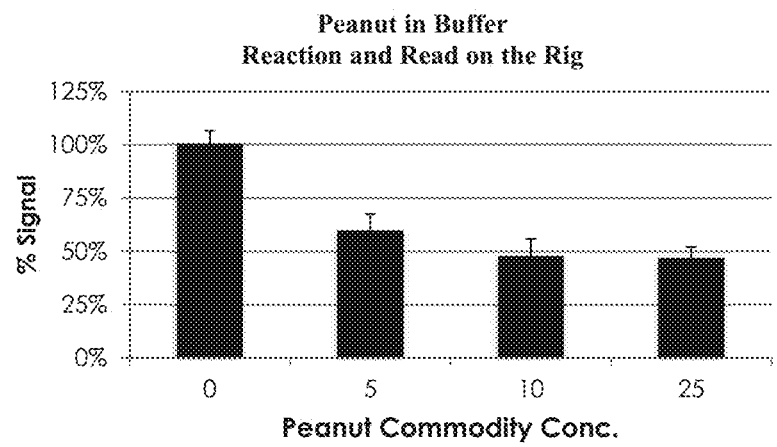
FIG. 9A shows peanut concentration curve in buffer measured on the detection assay with nucleic acid coated solid surface (chip) (N=5, LOD=1.25 ppm peanut).
Figure 9B:
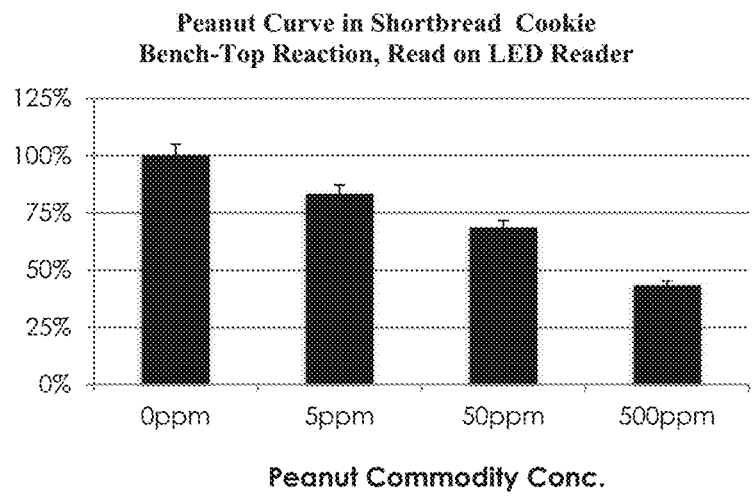
FIG. 9B shows peanut concentration curve in shortbread cookie measured in the detection assay with nucleic acid coated solid surface (chip) (N=3, LOD=1.25 ppm peanut).

Example 11: Sensitivity of the Detection Assay Based on Nucleic Acid Coated Chip Peanut detection using nucleic acid coated chips was evaluated in different detection assays and with different food matrices. The sensitivity of the detection assay based on nucleic acid coated chips was validated and confirmed. In this study, the anchor/linker sequence (5' 12C-Amine) AAAAATTCGCACACA (SEQ ID NO. 789) was printed on the surface of the chip. As shown in FIG. 9A, peanut diluted in buffer at various concentrations was incubated with peanut specific SPN (SEQ ID NO. 96: 5' (Cy5) TCGCA-CATTCCGCTTCTACCGGGGGGGTCGAGCTGAGTG-GATGCGAATCTGTGGG TGGGCCGTAAGTCCGTGTGTGCGAA3') and run through the DNA coated solid surface of the chip, the fluorescent signal recorded in nucleic acid coated chip based detection assay is correlated with the increased peanut concentration in buffer. The signal change can be detected as a low concentration of peanut (e.g., 5 ppm). Similarly, peanut diluted spiked in shortbread at various concentrations was incubated with peanut specific SPN and run through the DNA coated solid surface of the chip, the fluorescent signal recorded in nucleic acid coated chip based detection assay is correlated with the increased peanut concentration in buffer (FIG. 9A). The data also indicate that the SPN detection sensitivity is food dependent. In food matrices, the sensitivity is decreased as compared in simple buffer samples (FIGS. 9A and 9B).

Figure 10A:
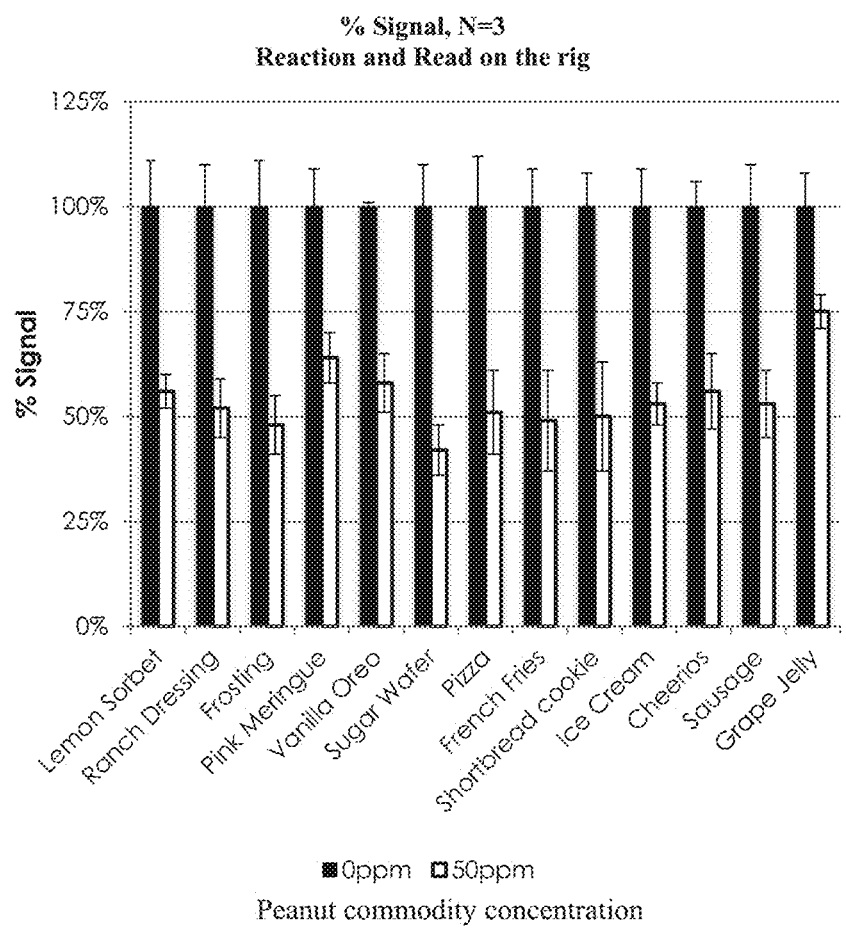
FIG. 10A demonstrates the sensitivity of detection assay with nucleic acid coated solid surface on the rig.
Figure 10B:
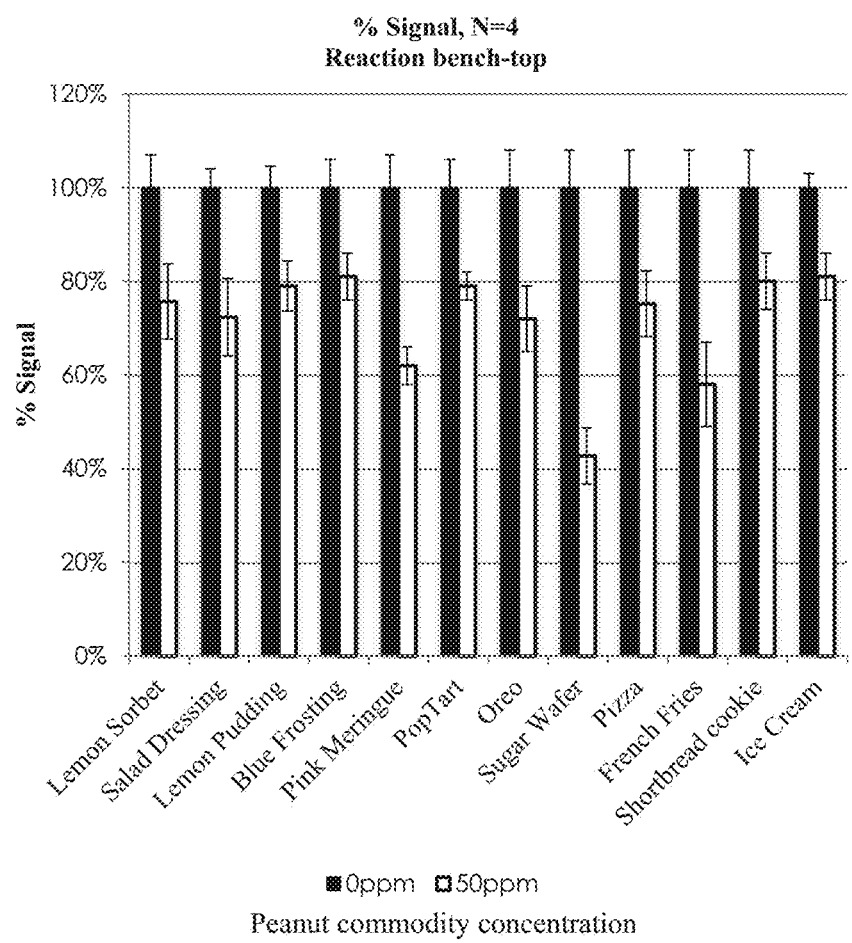
FIG. 10B demonstrates the sensitivity of detection assay with nucleic acid solid surface on the lab-grade bench-top chip.
Figure 10C:
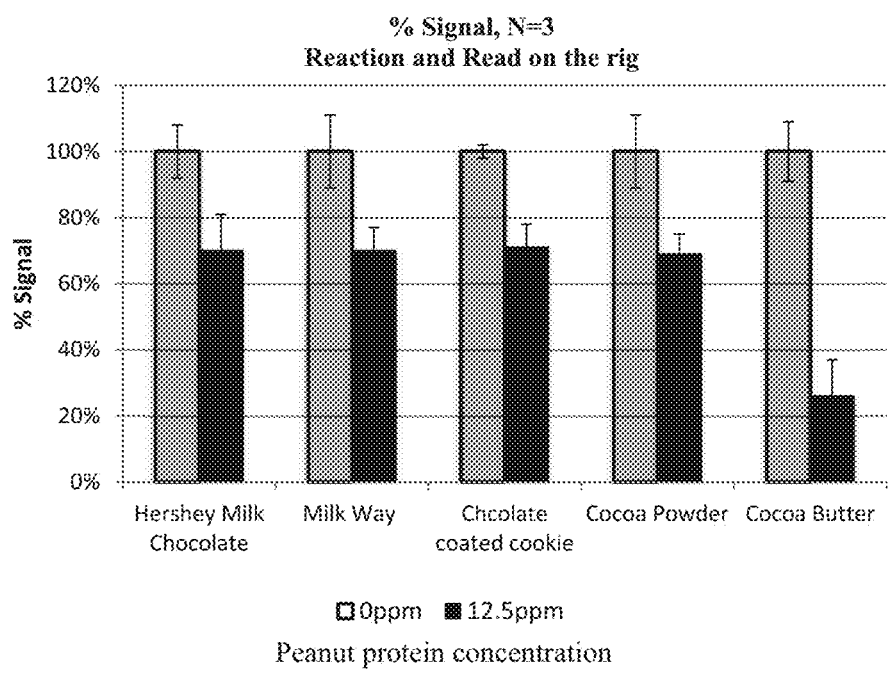
FIG. 10C is a representative histogram showing that the same detection sensitivity is retained in diverse chocolate matrices in nucleic acid coated chip based assay on the rig.

Detection assays with nucleic acid coated chip were tested both on a designed reaction system (e.g., the rig), and the benchtop reaction and LED read. More than 20 food samples were tested and the detection sensitivity of the SPN in solid surface based assay is repeatable using different solid surfaces (see, e.g., FIGS. 10A and 10B). The designed reaction system contains a test cartridge the hold the extraction buffer and wash buffer (e.g., HEPES buffer and TGK T-Buffer). SPN molecules at various concentrations (5 nM, 10 nM, or 50 nM) are pre-loaded in the extraction buffer. The wash buffer does not have the SPN. The cartridge also holds the DNA coated chip inside a reaction chamber within the cartridge. A driving system is also provided to activate the cartridge, driving the homogenization of the food and controlling the flow of the sample during the reaction. It also has an optical system attached to measure the detection system. In both reaction settings, a comparable detection sensitivity can be achieved (FIGS. 10A and 10B). The same sensitivity of 12.5 ppm peanut protein (equal to 50 ppm peanut commodity) is also retained in diverse chocolate matrices as tested on the rig with nucleic acid coated chips (FIG. 10C).

Example 12. Comparison of Detection Sensitivity Between SPN-Magnetic Bead Conjugates and Nucleic Acid Coated Solid Surface (Chip)

Figure 11A:
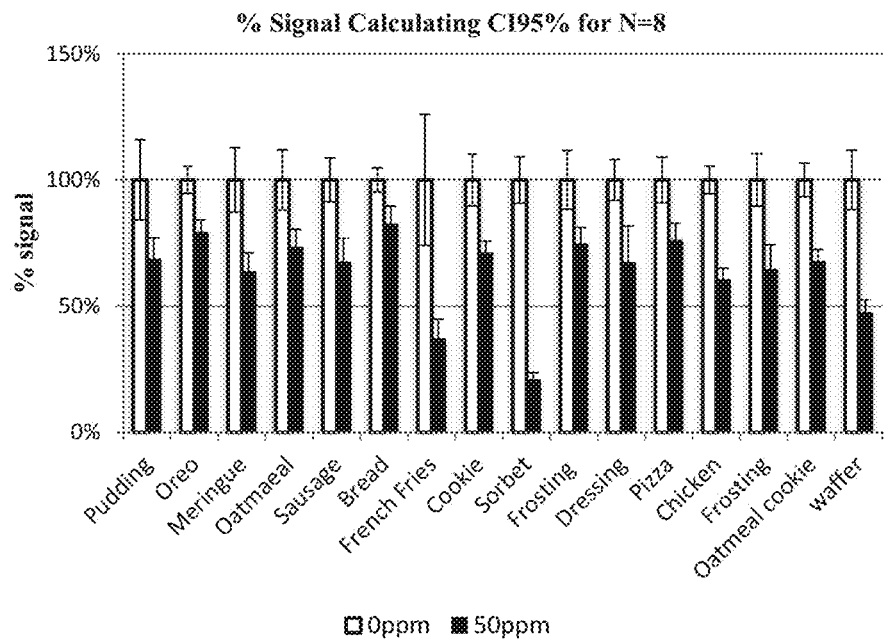
FIG. 11A demonstrates the detection signal read by the lab-grade LED reader in different food matrices in magnetic bead conjugates based assay. The food samples were prepared using GentleMACS homogenizer and processed by centrifugation.
Figure 11B:
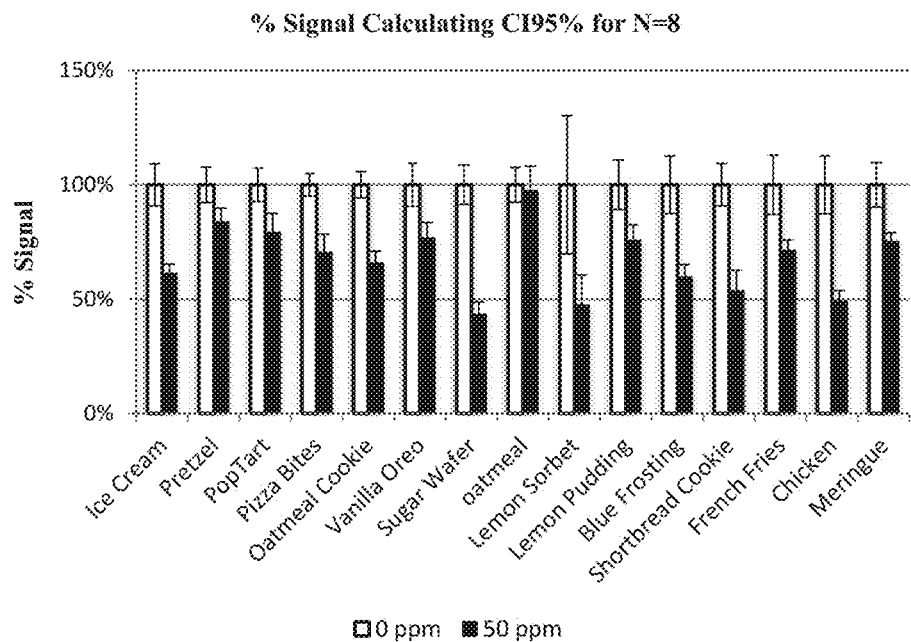
FIG. 11B demonstrates the detection signal read by the designed optic sensor in different food matrices in solid surface (chip) based assay. The food samples were prepared using GentleMACS homogenizer and processed by centrifugation.
Figure 11C:
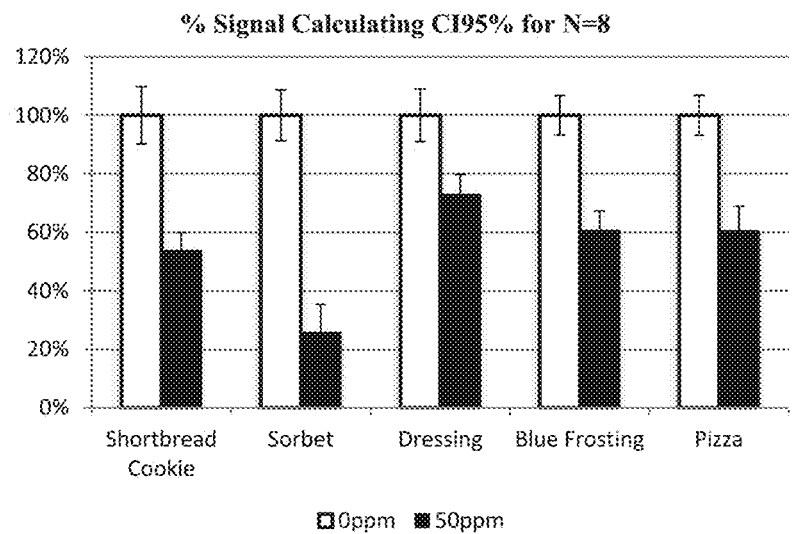
FIG. 11C demonstrates the detection signal read by the lab-grade LED based reader in 5 food matrices in magnetic bead conjugates based assay. The food samples were prepared using designed rotor homogenizer and filtered using 0.2 micron PES filter.

Detection assays using SPN-magnetic bead conjugates and nucleic acid coated chips were validated in various conditions using a variety of different food samples. The detection sensitivity is confirmed in different conditions. For assays using SPN-magnetic bead conjugates, food samples without or with 50 ppm peanut were prepared using GentleMACS homogenizer and centrifuged. The processed samples were then incubated with SPN-magnetic bead conjugates and fluorescent signals were recorded using lab-grade LED based reader. The 50 ppm sensitivity was confirmed in 20 food samples tested (FIG. 11A). In a parallel study, food samples without or with 50 ppm peanut were prepared using rotor-dependent homogenizer and homogenized samples were filtered using 0.2 mm PES filter. The processed samples were then incubated with SPN-magnetic bead conjugates and fluorescent signals were recorded using lab-grade LED based reader. The 50 ppm sensitivity was confirmed in 5 food samples tested (FIG. 11C).

Figure 11D:
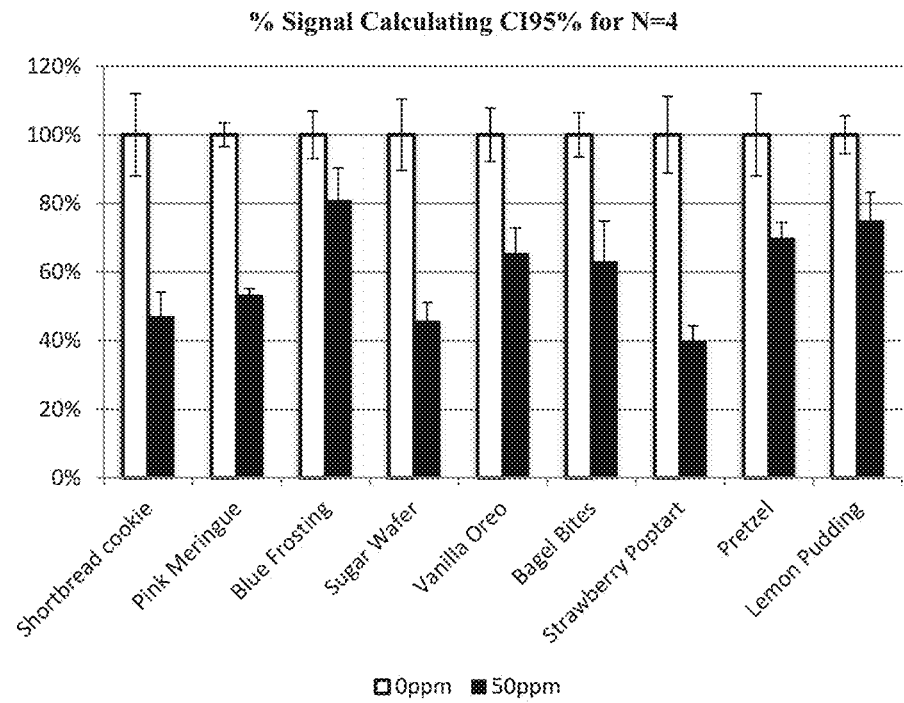
FIG. 11D demonstrates the detection signal read by the designed optic sensor in 9 food matrices in solid surface (chip) based assay. The food samples were prepared using designed rotor homogenizer and filtered using 0.1 micron PES filter.

Detection assays were also performed using nucleic acid coated chips as described in Example 10. Food samples without or with 50 ppm peanut were prepared using GentleMACS homogenizer and centrifuged, or alternatively prepared using rotor-dependent homogenizer and filtered using 0.1 mm PES filter. The processed samples were then incubated with a fixed concentration of aptamer specific to peanut allergen. The mixed samples were added to the nucleic acid coated chips. After incubation and wash, the fluorescent signals were recorded using designed optical sensors. The 50 ppm sensitivity was achieved in different food samples (FIG. 11B) and was further confirmed in 9 food samples tested (FIG. 11D).

The sensitivity of SPN-magnetic beads and nucleic acid coated chips was also tested in different reaction settings such as standard bench-top reaction chamber and a designed reaction chamber (e.g., the rig). The rig is a benchtop fixture that includes a motor, syringe pump and valving the enables the homogenization of the food sample, filtering through a filter bed and running the sample over the reaction chamber in which the DNA coated chip is located. The rig enables controlled washing. The detailed conditions are listed in Table 23. In all conditions tested, the 50 ppm sensitivity can be achieved.

TABLE 23

Validation of assay sensitivity

| Assay | Assay conditions | Food | Fluorescent signal reduction 0 ppm peanut | 50 ppm peanut |
|---|---|---|---|---|
| Magnetic beads (N = 3) | GentleMACS homogenizer and centrifugation; Lab-standard bench-top reaction; designed optical sensor | Lemon sobert | 100% | 22% |
| | | Shortbread cooike | 100% | 67% |
| | | Blue frosting | 100% | 79% |
| | | Pizza | 100% | 70% |
| | | Dressing | 100% | 84% |
| Nucleic acid solid surface (N = 4) | Designed Rotor-homogenizer and 1 mm PES filter; Lab-standard bench-top reaction; designed optical sensor | Lemon sobert | 100% | 76% |
| | | Shortbread cooike | 100% | 69% |
| | | Blue frosting | 100% | 67% |
| | | Pizza | 100% | 76% |
| | | Dressing | 100% | 73% |
| Magnetic beads (N = 2) | Designed Rotor-homogenizer and bulk filters; designed rig reaction chamber; designed optical sensor | Lemon sobert | 100% | 36% |
| | | Shortbread cooike | 100% | 65% |
| | | Blue frosting | 100% | 72% |
| | | Pizza | 100% | 51% |
| | | Dressing | 100% | 0% |
| Nucleic acid solid surface (N = 3) | Designed Rotor-homogenizer and 1 mm PES filter; designed rig reaction chamber; designed optical sensor | Lemon sobert | 100% | 36% |
| | | Shortbread cooike | 100% | 50% |
| | | Blue frosting | 100% | 72% |
| | | Pizza | 100% | 56% |
| | | Dressing | 100% | 53% |

Example 13: Optimizing Detection Assays on Solid Surface

Limited Reaction Buffer

Figure 12:
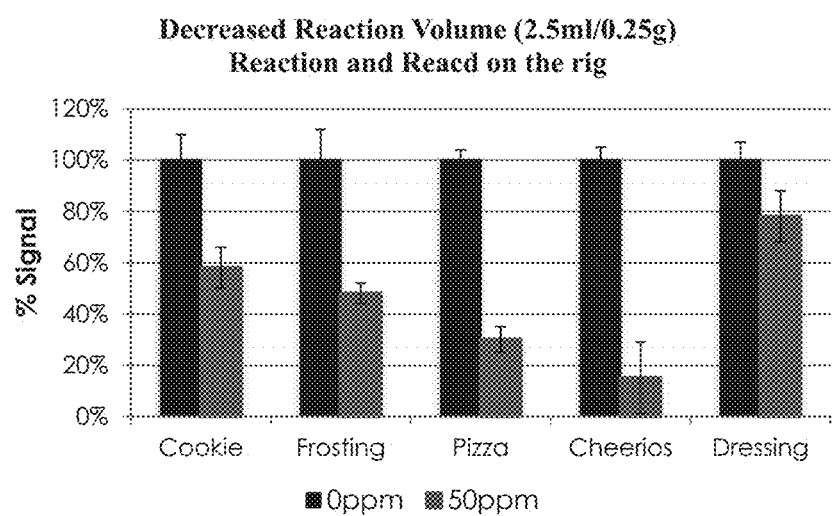
FIG. 12 demonstrates the effect of decreased reaction volume on detection sensitivity.

The detection assay run on nucleic acid coated solid surface (e.g., chip) was optimized in several aspects and its sensitivity was validated in various reaction conditions. The effect of buffer volume on the detection sensitivity was tested in one study. In the nucleic acid chip assay, when the reaction volume is decreased by 50% (2.5 ml) and only half of the sample size (0.25 g per sample) was used, the detection result indicates that limited buffer volume and reduced sample size has minimal effect on the detection sensitivity of SPNs and solid surface assays (FIG. 12).

Internal Control

Figure 13A:
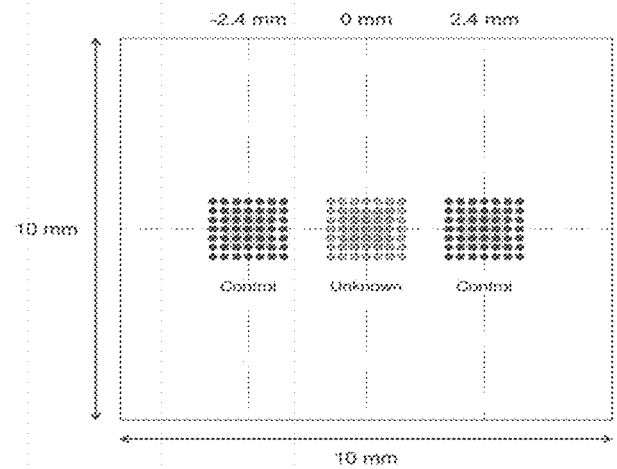
FIG. 13A is a representative diagram of the control panels and detection area (unknown) on the chip.
Figure 13B:
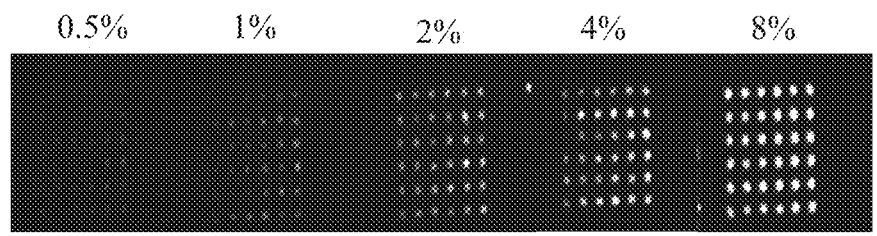
FIG. 13B is a representative signal reading of the chip.
Figure 13C:
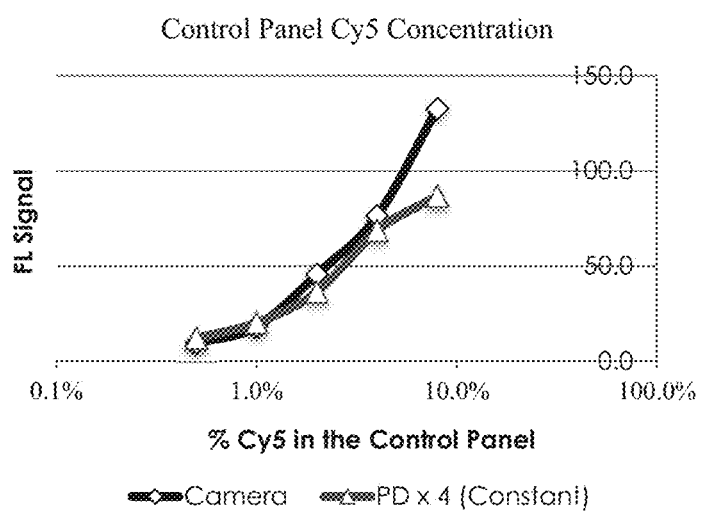
FIG. 13C demonstrate a representative control signal measurement.

To reduce background recording and signals from non-specific bindings, control signals to subtract these non-specific readings are important to optimize the assay. An internal control signal was recorded to correct signal measurement. The two control panels as shown in FIG. 13A contain the sequence GAAAAGTGCTCATCTGT-GAACTCTAT (SEQ ID NO. 804) that has CY5 bound to on end and amine on the other side. The sequences are printed on the surface of the chip at various patterns (not shown) but keep the similar relevant positions to the detection area where DNA anchor/linker sequences specific to SPNs are printed (as the diagram shown in FIG. 13A). In general, control areas are located at various locations outside of the detection area on the chip. After sample incubation and wash, fluorescence signals from the detection area and control areas are read and analysed to indicate the concentration of allergen detected in the sample.

Concentration of MgCl2

Figure 14A:
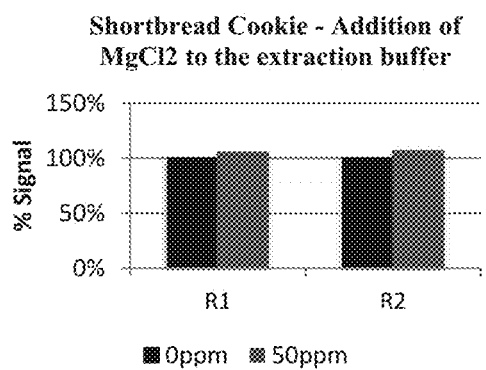
FIG. 14A depicts the effect of MgCl2 when added to the extraction buffer.
Figure 14B:
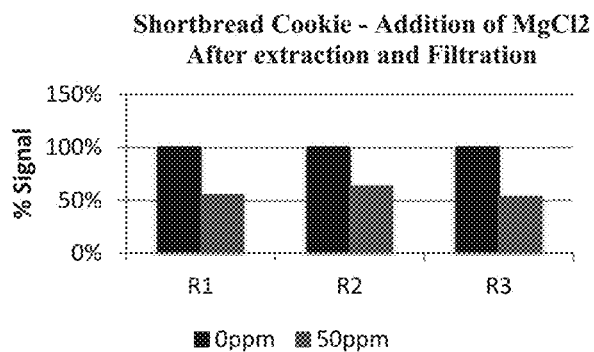
FIG. 14B depicts the effect of MgCl2 when added after extraction and filtration.
Figure 14C:
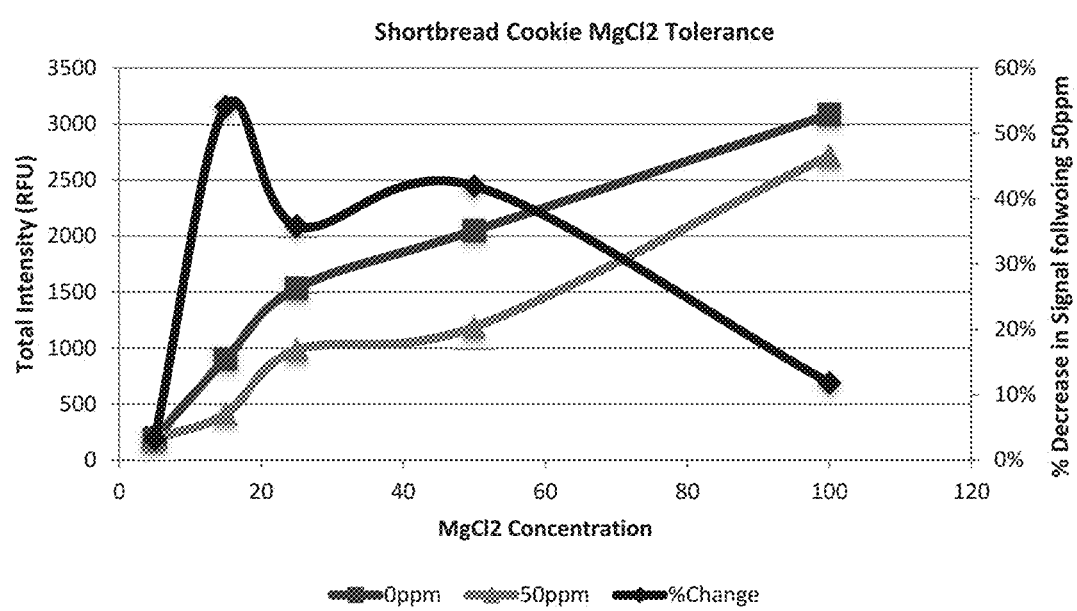
FIG. 14C is a representative reading of detection signals with various concentrations of MgCl2.

Fluorescent signal is likely be affected by many factors such as salts and buffer concentration, etc. The concentration of MgCl2 in reaction buffer is to optimize the detection assay to achieve high-sensitive and intense signal. 0 mM to 120 mM MgCl2 was tested and MgCl2 was added either to extraction buffer or after food sample extraction and filtration. The results suggest that addition of MgCl2 to extraction buffer completely eliminates sensitivity. The MgCl2 concentration needs to be tightly controlled between 25 mM and 50 mM. Lower or higher concentration of MgCl2 affects both sensitivity and signal intensity (FIGS. 14A, 14B and 14C)

Optimization of Detection Assay on the Rig

In addition to internal control, various parameters that affect the efficiency of detection assay were optimized including the steps of pre-blocking the DNA coated chips, decreasing reaction time and washing. It is found that DNA-chip, the solid surface can be effectively blocked by BSA, which reduce non-specific signal. During the process of assaying, the reaction time can be decreased from 6 minutes to about 64 seconds. Optimized steps include removing air bubbles for both the reaction and wash, decreasing incubation time of food sample and SPNs, transitioning to a slow flow of incubation, increasing volume of reaction to flow over the chip and increasing flow rate of solution to accommodate the volume in 30 seconds. One example of the optimized reaction step and time is shown in Table 24.

TABLE 24

Optimization of reaction on the rig (solid surface)

| | Step | Time |
|---|---|---|
| Sample process | Homogenization of food in 5 ml of buffer with 20 nM SPN; Filtration 1 micron FES filter | 40 Sec |
| Reaction process | Prime Channels and remove BSA | 4 Sec |
| | Adding 500 ul of food and SPN filtrate | 30 Sec |
| | Wash 500 ul | 20 Sec |
| | Air dry | 4 Sec |
| | Read | 1 Sec |

Figure 15:
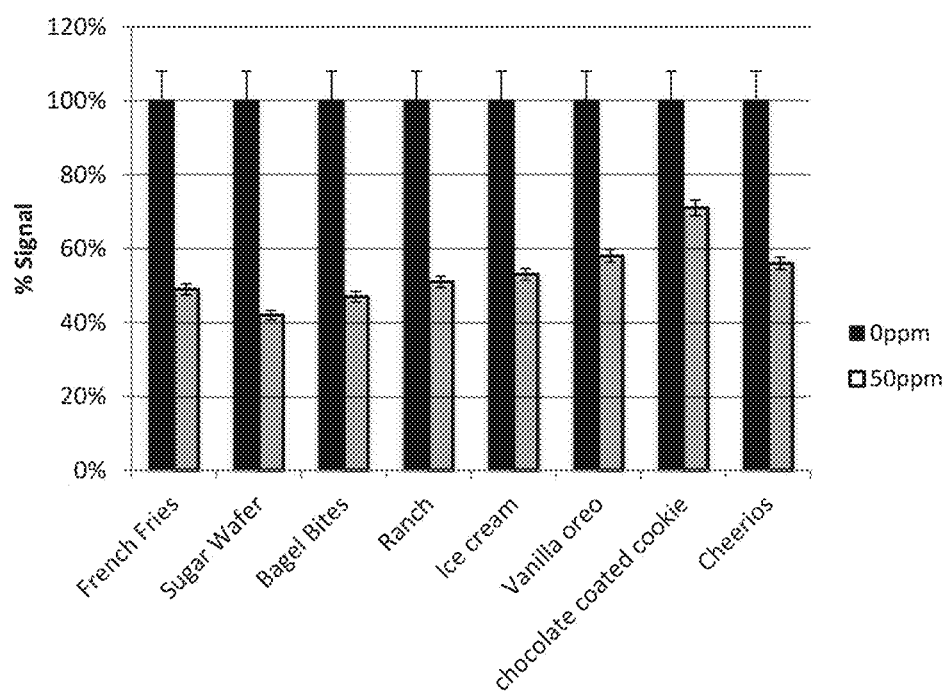
FIG. 15 shows the sensitivity in solid surface assays with optimized conditions and reduced reaction time.

In this protocol of detection reaction within 64 seconds, the assay sensitivity is retained (FIG. 15).

Filtration

Different filters were tested and compared for efficiency in removing food particles and its effect on signal read. Three different filters: fish/netting, cotton/glass, and cotton/netting were tested and compared in 6 different food matrices spiked with peanut (Table 25). Dependent of food matrices, a different combination of filters may be used to increase allergen extraction from the sample; and to deplete other components such as fat and other particles.

TABLE 25

Filter comparison

|  | short-Bread Cookie | Blue Frosting | White Frosting | Bagle-Bites | Ranch Dressing (wishbone) | Sorbert |
|---|---|---|---|---|---|---|
| Cotton/glass | 100% | 100% | 100% | 100% | 100% | 100% |
| 0 ppm peanut | 100% | 100% | 100% | 100% | 100% | 100% |
| Cotton/glass | 59% | 77% | 16% | 63% | 60% | 85% |
| 50 ppm peanut | 54% | 59% | 35% | 67% | 47% | 51% |
| Fish/netting | 100% | 100% | 100% | 100% | 100% | 100% |
| 0 ppm peanut | 100% | 100% | 100% | 100% | 100% | 100% |
| Fish/netting | / | 76% | 95% | 72% | 55% | 85% |
| 50 ppm peanut | 73% | 54% | 53% | 83% | / | 75% |
| Cotton/netting | 100% | 100% | / | 100% | 100% | 0% |
| 0 ppm peanut | 100% | 100% | / | 100% | 100% | 0% |
| Cotton/netting | 42% | 49% | / | 9% | 59% | 0% |
| 50 ppm peanut | 33% | 60% | / | 79% | 73% | 0% |

Example 14: Stability of Detection Agents and Other Agents for Detection Assays

Figure 16A:
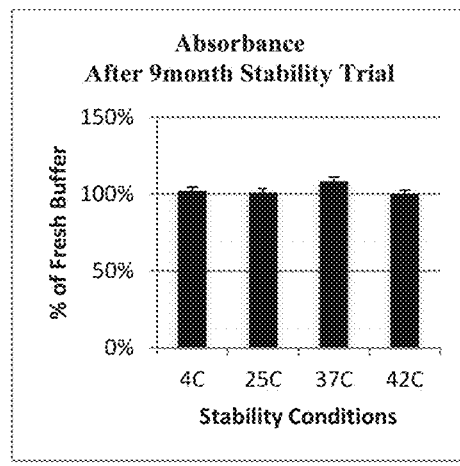
FIGS. 16A to 16D demonstrate the stability of reaction agents including SPNs and extraction buffer.
Figure 16B:
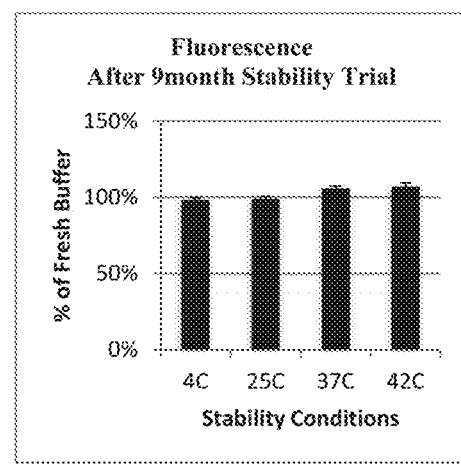
Figure 16C:
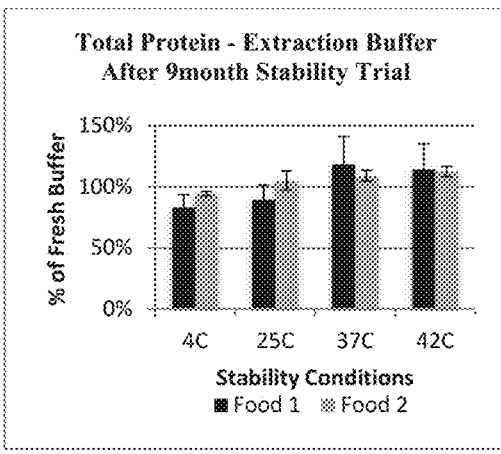
Figure 16D:
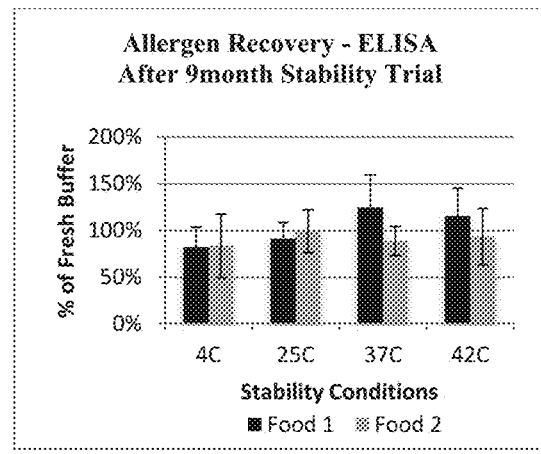

Components used for the present detection assay need to be stable at ambient temperature. Examples of agents and other parts employed to run an allergen assay, include extraction buffer, wash buffer, Flagged-SPN and DNA chips. The stability test indicates that fluorescent labeled SPN (e.g., Texas-Red labeled SPN) is stable and its activity remains at least for one month at various temperatures. (Table 26) as measured with fluorescent polarization (FP). After 9 month storage, significant fluorescent signal can still be detected (FIGS. 16A and 16B). Buffers used for the detection assay can remain stable for at least 9 month (FIGS. 16C and 16D).

TABLE 26

Stability of Texas-red labeled SPN activity at various temperatures

| | Delta signal (mP) | | | | | | |
|---|---|---|---|---|---|---|---|
| | Day 0 | Day 1 | Day 2 | Day 4 | Week 2 | Week 3 | Week 4 |
| | 4° C. | | | | | | |
| 5000 | 152 | 153 | 143 | 153 | 154 | 148 | 128 |
| 500 | 114 | 109 | 108 | 105 | 106 | 92 | 75 |
| 50 | 36 | 27 | 22 | 37 | 31 | 24 | 21 |
| 5 | 4 | 7 | (1) | 8 | 6 | 8 | 8 |
| | 25° C. | | | | | | |
| 5000 | 152 | 151 | 148 | 149 | 164 | 158 | 141 |
| 500 | 114 | 99 | 98 | 107 | 115 | 104 | 81 |
| 50 | 36 | 26 | 20 | 35 | 35 | 27 | 21 |
| 5 | 4 | 2 | 2 | 12 | 4 | 6 | 4 |
| | 42° C. | | | | | | |
| 5000 | 152 | 147 | 136 | 152 | 161 | 190 | 160 |
| 500 | 114 | 104 | 119 | 109 | 119 | 121 | 103 |
| 50 | 36 | 22 | 31 | 33 | 34 | 34 | 26 |
| 5 | 4 | 1 | 4 | 10 | 5 | 3 | 3 |

SEQUENCE LISTING (1866 sequences)

SEQ ID NO: 1 - DNA, 35 bp, Artificial Sequence
  Synthetic sequence-aptamer core sequence
gcacaccacgtcaaaaatcattgtcaccacgaagc

SEQ ID NO: 2 - DNA, 35 bp, Artificial Sequence
  Synthetic sequence-aptamer core sequence
tgcgcaacataagtctcttgaaagaccacgttcaa

SEQ ID NO: 3 - DNA, 35 bp, Artificial Sequence
  Synthetic sequence-aptamer core sequence
cacccaccataccagaaatgttgacaccacgtgga

SEQ ID NO: 4 - DNA, 35 bp, Artificial Sequence
  Synthetic sequence-aptamer core sequence
tgcacaatgtaattatcaaaatacaccacgttggc

SEQ ID NO: 5 - DNA, 35 bp, Artificial Sequence
  Synthetic sequence-aptamer core sequence
ccacatcgtgcaatgcccgaaacataccacgtaga

SEQ ID NO: 6 - DNA, 35 bp, Artificial Sequence
  Synthetic sequence-aptamer core sequence
ctatgcagtgatgattaaagataccaccacgtgag

SEQ ID NO: 7 - DNA, 99 bp, Artificial Sequence
  Synthetic sequence-aptamer full sequence
taatacgactcactataggcgtagcctgatgaggcacaccacgtcaaaaatcattgtcaccacgaagccgaaacgtggtgaaagccacgtagctgcgcc

SEQ ID NO: 8 - DNA, 99 bp, Artificial Sequence
  Synthetic sequence-aptamer full sequence
taatacgactcactataggcgtagcctgatgagtgcgcaacataagtctcttgaaagaccacgttcaacgaaacgtggtgaaagccacgtagctgcgcc

SEQ ID NO: 9 - DNA, 99 bp, Artificial Sequence
  Synthetic sequence-aptamer full sequence
taatacgactcactataggcgtagcctgatgagcacccaccataccagaaatgttgacaccacgtggacgaaacgtggtgaaagccacgtagctgcgcc

SEQ ID NO: 10 - DNA, 99 bp, Artificial Sequence
  Synthetic sequence-aptamer full sequence
taatacgactcactataggcgtagcctgatgagtgcacaatgtaattatcaaaatacaccacgttggccgaaacgtggtgaaagccacgtagctgcgcc

SEQ ID NO: 11 - DNA, 99 bp, Artificial Sequence
  Synthetic sequence-aptamer full sequence
taatacgactcactataggcgtagcctgatgagccacatcgtgcaatgcccgaaacataccacgtagacgaaacgtggtgaaagccacgtagctgcgcc

SEQ ID NO: 12 - DNA, 99 bp, Artificial Sequence
  Synthetic sequence-aptamer full sequence
taatacgactcactataggcgtagcctgatgagctatgcagtgatgattaaagataccaccacgtgagcgaaacgtggtgaaagccacgtagctgcgcc

SEQ ID NO: 13 - DNA, 24 bp, Artificial Sequence
  Synthetic sequence-aptamer core sequence
caaatagttacaaacaccacgtag

SEQ ID NO: 14 - DNA, 25 bp, Artificial Sequence
  Synthetic sequence-aptamer core sequence
cccaactgtacagtacaccacgtag

SEQ ID NO: 15 - DNA, 25 bp, Artificial Sequence
  Synthetic sequence-aptamer core sequence
cacacacacattccaccacgtcacg

SEQ ID NO: 16 - DNA, 25 bp, Artificial Sequence
  Synthetic sequence-aptamer core sequence
cacacgttaccacaccacgttgacg

SEQ ID NO: 17 - DNA, 25 bp, Artificial Sequence
  Synthetic sequence-aptamer core sequence
cgtgcccgaaacacacaccacgatg

SEQ ID NO: 18 - DNA, 25 bp, Artificial Sequence
  Synthetic sequence-aptamer core sequence
ctcaccacataccatgtaccacgtg

SEQ ID NO: 19 - DNA, 88 bp, Artificial Sequence
  Synthetic sequence-aptamer full sequence
taatacgactcactataggcgtagcctgatgagcaaatagttacaaacaccacgtagcgaaacgtggtgaaagccacgtagctgcgcc

SEQ ID NO: 20 - DNA, 89 bp, Artificial Sequence
  Synthetic sequence-aptamer full sequence
taatacgactcactataggcgtagcctgatgagcccaactgtacagtacaccacgtagcgaaacgtggtgaaagccacgtagctgcgcc

SEQ ID NO: 21 - DNA, 89 bp, Artificial Sequence
  Synthetic sequence-aptamer full sequence
taatacgactcactataggcgtagcctgatgagcacacacacattccaccacgtcacgcgaaacgtggtgaaagccacgtagctgcgcc

SEQ ID NO: 22 - DNA, 89 bp, Artificial Sequence
  Synthetic sequence-aptamer full sequence
taatacgactcactataggcgtagcctgatgagcacacgttaccacaccacgttgacgcgaaacgtggtgaaagccacgtagctgcgcc

SEQ ID NO: 23 - DNA, 89 bp, Artificial Sequence
  Synthetic sequence-aptamer full sequence
taatacgactcactataggcgtagcctgatgagcgtgcccgaaacacacaccacgatgcgaaacgtggtgaaagccacgtagctgcgcc

SEQ ID NO: 24 - DNA, 89 bp, Artificial Sequence
  Synthetic sequence-aptamer full sequence
taatacgactcactataggcgtagcctgatgagctcaccacataccatgtaccacgtgcgaaacgtggtgaaagccacgtagctgcgcc

SEQ ID NO: 25 - DNA, 30 bp, Artificial Sequence
  Synthetic sequence-aptamer core sequence
ttcactggctgcacccaccaccgcgttcca

SEQ ID NO: 26 - DNA, 30 bp, Artificial Sequence
  Synthetic sequence-aptamer core sequence
catccacggtgacgctaatcccacgttcga

SEQ ID NO: 27 - DNA, 30 bp, Artificial Sequence
  Synthetic sequence-aptamer core sequence
acaatgcagatgcgcccaccacggatcact

SEQ ID NO: 28 - DNA, 30 bp, Artificial Sequence
  Synthetic sequence-aptamer core sequence
caaccaagcacgctgcatcacgtttcatcg

SEQ ID NO: 29 - DNA, 30 bp, Artificial Sequence
  Synthetic sequence-aptamer core sequence
ctcacagcccgaaacacatcgccacgttca

SEQ ID NO: 30 - DNA, 94 bp, Artificial Sequence
  Synthetic sequence-aptamer full sequence
taatacgactcactataggcgtagcctgatgagttcactggctgcacccaccaccgcgttccacgaaacgtggtgaaagccacgtagctgcgcc

SEQ ID NO: 31 - DNA, 94 bp, Artificial Sequence
  Synthetic sequence-aptamer full sequence
taatacgactcactataggcgtagcctgatgagcatccacggtgacgctaatcccacgttcgacgaaacgtggtgaaagccacgtagctgcgcc

SEQ ID NO: 32 - DNA, 94 bp, Artificial Sequence
  Synthetic sequence-aptamer full sequence
taatacgactcactataggcgtagcctgatgagacaatgcagatgcgcccaccacggatcactcgaaacgtggtgaaagccacgtagctgcgcc

SEQ ID NO: 33 - DNA, 94 bp, Artificial Sequence
  Synthetic sequence-aptamer full sequence
taatacgactcactataggcgtagcctgatgagcaaccaagcacgctgcatcacgtttcatcgcgaaacgtggtgaaagccacgtagctgcgcc

SEQ ID NO: 34 - DNA, 94 bp, Artificial Sequence
  Synthetic sequence-aptamer full sequence
taatacgactcactataggcgtagcctgatgagctcacagcccgaaacacatcgccacgttcacgaaacgtggtgaaagccacgtagctgcgcc

SEQ ID NO: 35 - DNA, 40 bp, Artificial Sequence
  Synthetic sequence-aptamer core sequence
ctcaatactacgtcaattcacagatgatagacaccacgga

SEQ ID NO: 36 - DNA, 40 bp, Artificial Sequence
  Synthetic sequence-aptamer core sequence
tccaacaccacgtaacgtacactgcatgtgattggtgcaa

SEQ ID NO: 37 - DNA, 40 bp, Artificial Sequence
  Synthetic sequence-aptamer core sequence
tggcgccgactgatcaactagacatcacgttagcattccg

SEQ ID NO: 38 - DNA, 40 bp, Artificial Sequence
  Synthetic sequence-aptamer core sequence
ccagcaaccaggttacctcccatcacgcttcgtctcagga

SEQ ID NO: 39 - DNA, 40 bp, Artificial Sequence
  Synthetic sequence-aptamer core sequence
ctgacaccacaaacgattatgaccacgttatcgtacatag

SEQ ID NO: 40 - DNA, 40 bp, Artificial Sequence
  Synthetic sequence-aptamer core sequence
taggtcaagtgcgctaaaacacaccgcgttagttcaccaa

SEQ ID NO: 41 - DNA, 104 bp, Artificial Sequence
  Synthetic sequence-aptamer full sequence
taatacgactcactataggcgtagcctgatgagctcaatactacgtcaattcacagatgatagacaccacggacgaaacgtggtgaaagccacgtagctgcgcc

SEQ ID NO: 42 - DNA, 104 bp, Artificial Sequence
  Synthetic sequence-aptamer full sequence
taatacgactcactataggcgtagcctgatgagtccaacaccacgtaacgtacactgcatgtgattggtgcaacgaaacgtggtgaaagccacgtagctgcgcc

SEQ ID NO: 43 - DNA, 104 bp, Artificial Sequence
  Synthetic sequence-aptamer full sequence
taatacgactcactataggcgtagcctgatgagtggcgccgactgatcaactagacatcacgttagcattccgcgaaacgtggtgaaagccacgtagctgcgcc

SEQ ID NO: 44 - DNA, 104 bp, Artificial Sequence
  Synthetic sequence-aptamer full sequence
taatacgactcactataggcgtagcctgatgagccagcaaccaggttacctcccatcacgcttcgtctcaggacgaaacgtggtgaaagccacgtagctgcgcc

SEQ ID NO: 45 - DNA, 104 bp, Artificial Sequence
  Synthetic sequence-aptamer full sequence
taatacgactcactataggcgtagcctgatgagctgacaccacaaacgattatgaccacgttatcgtacatagcgaaacgtggtgaaagccacgtagctgcgcc

SEQ ID NO: 46 - DNA, 104 bp, Artificial Sequence
  Synthetic sequence-aptamer full sequence
taatacgactcactataggcgtagcctgatgagtaggtcaagtgcgctaaaacacaccgcgttagttcaccaacgaaacgtggtgaaagccacgtagctgcgcc

SEQ ID NO: 47 - DNA, 46 bp, Artificial Sequence
  Synthetic sequence-aptamer core sequence
ggccacctcactgtgttttgttgcacaacataatatgatgacgtgc

SEQ ID NO: 48 - DNA, 45 bp, Artificial Sequence
  Synthetic sequence-aptamer core sequence
gcgttccccaccgttgcccacgcttaactggacaaagatgggccc

SEQ ID NO: 49 - DNA, 45 bp, Artificial Sequence
  Synthetic sequence-aptamer core sequence
tctgtgcacatcactcgacctctacggctgtattgatcctgcata

SEQ ID NO: 50 - DNA, 45 bp, Artificial Sequence
  Synthetic sequence-aptamer core sequence
cgtccaacgttcgatcagaaccgcgttcaggctgatgattgtacg

SEQ ID NO: 51 - DNA, 45 bp, Artificial Sequence
  Synthetic sequence-aptamer core sequence
catcagtgcgttctgcctttgcaaccacacaacacaccgtatgag

SEQ ID NO: 52 - DNA, 45 bp, Artificial Sequence
  Synthetic sequence-aptamer core sequence
ccaactgtgcacactgttcgcttatcgagctgtgtacctccatag

SEQ ID NO: 53 - DNA, 109 bp, Artificial Sequence
  Synthetic sequence-aptamer full sequence
taatacgactcactataggcgtagcctgatgaggccacctcactgtgttttgttgcacaacataatatgatgacgtgccgaaacgtggtgaaagccacgtagctgcgcc

SEQ ID NO: 54 - DNA, 109 bp, Artificial Sequence
  Synthetic sequence-aptamer full sequence
taatacgactcactataggcgtagcctgatgaggcgttccccaccgttgcccacgcttaactggacaaagatgggccccgaaacgtggtgaaagccacgtagctgcgcc

SEQ ID NO: 55 - DNA, 109 bp, Artificial Sequence
  Synthetic sequence-aptamer full sequence
taatacgactcactataggcgtagcctgatgagtctgtgcacatcactcgacctctacggctgtattgatcctgcatacgaaacgtggtgaaagccacgtagctgcgcc

SEQ ID NO: 56 - DNA, 109 bp, Artificial Sequence
  Synthetic sequence-aptamer full sequence
taatacgactcactataggcgtagcctgatgagcatcagtgcgttctgcctttgcaaccacacaacacaccgtatgagcgaaacgtggtgaaagccacgtagctgcgcc

SEQ ID NO: 57 - DNA, 110 bp, Artificial Sequence
  Synthetic sequence-aptamer full sequence
ttaatacgactcactataggcgtagcctgatgagcgtccaacgttcgatcagaaccgcgttcaggctgatgattgtacgcgaaacgtggtgaaagccacgtagctgcgcc

SEQ ID NO: 58 - DNA, 109 bp, Artificial Sequence
  Synthetic sequence-aptamer full sequence
taatacgactcactataggcgtagcctgatgagccaactgtgcacactgttcgcttatcgagctgtgtacctccatagcgaaacgtggtgaaagccacgtagctgcgcc

SEQ ID NO: 59 - DNA, 30 bp, Artificial Sequence
  Synthetic sequence-aptamer core sequence
cttggtcacctttcctgacattaacacagg

SEQ ID NO: 60 - DNA, 30 bp, Artificial Sequence
  Synthetic sequence-aptamer core sequence
ttttcccgatacggctacgaattgcgacaa

SEQ ID NO: 61 - DNA, 30 bp, Artificial Sequence
  Synthetic sequence-aptamer core sequence
gcaccaattttaccgattttggtggacagc

SEQ ID NO: 62 - DNA, 30 bp, Artificial Sequence
  Synthetic sequence-aptamer core sequence
cgtacaacccaccaccgttgtccacaaatg

SEQ ID NO: 63 - DNA, 30 bp, Artificial Sequence
  Synthetic sequence-aptamer core sequence
tgcgtcaacggccgtcccgaaacgtgaata

SEQ ID NO: 64 - DNA, 30 bp, Artificial Sequence
  Synthetic sequence-aptamer core sequence
gttaccccgaaacggccctaactgcatcag

SEQ ID NO: 65 - DNA, 94 bp, Artificial Sequence
  Synthetic sequence-aptamer full sequence
taatacgactcactataggcgtagcctgatgagcttggtcacctttcctgacattaacacaggcgaaacgtggtgaaagccacgtagctgcgcc

SEQ ID NO: 66 - DNA, 94 bp, Artificial Sequence
  Synthetic sequence-aptamer full sequence
taatacgactcactataggcgtagcctgatgagttttcccgatacggctacgaattgcgacaacgaaacgtggtgaaagccacgtagctgcgcc

SEQ ID NO: 67 - DNA, 94 bp, Artificial Sequence
  Synthetic sequence-aptamer full sequence
taatacgactcactataggcgtagcctgatgaggcaccaattttaccgattttggtggacagccgaaacgtggtgaaagccacgtagctgcgcc

SEQ ID NO: 68 - DNA, 94 bp, Artificial Sequence
  Synthetic sequence-aptamer full sequence
taatacgactcactataggcgtagcctgatgagcgtacaacccaccaccgttgtccacaaatgcgaaacgtggtgaaagccacgtagctgcgcc

SEQ ID NO: 69 - DNA, 94 bp, Artificial Sequence
  Synthetic sequence-aptamer full sequence
taatacgactcactataggcgtagcctgatgagtgcgtcaacggccgtcccgaaacgtgaatacgaaacgtggtgaaagccacgtagctgcgcc

SEQ ID NO: 70 - DNA, 94 bp, Artificial Sequence
  Synthetic sequence-aptamer full sequence
taatacgactcactataggcgtagcctgatgaggttaccccgaaacggccctaactgcatcagcgaaacgtggtgaaagccacgtagctgcgcc

SEQ ID NO: 71 - DNA, 25 bp, Artificial Sequence
  Synthetic sequence-aptamer core sequence
ccgcatcaccacccaaaccaccgtt

SEQ ID NO: 72 - DNA, 25 bp, Artificial Sequence
  Synthetic sequence-aptamer core sequence
cctgctccatccgcgccagcctcac

SEQ ID NO: 73 - DNA, 25 bp, Artificial Sequence
  Synthetic sequence-aptamer core sequence
ccaatctcctgcccacgccgttcca

SEQ ID NO: 74 - DNA, 25 bp, Artificial Sequence
  Synthetic sequence-aptamer core sequence
ccaatcaaggaccgccttcaccgct

SEQ ID NO: 75 - DNA, 25 bp, Artificial Sequence
  Synthetic sequence-aptamer core sequence
actctcgcatcaccagccaactcac

SEQ ID NO: 76 - DNA, 89 bp, Artificial Sequence
  Synthetic sequence-aptamer full sequence
taatacgactcactataggcgtagcctgatgagccgcatcaccacccaaaccaccgttcgaaacgtggtgaaagccacgtagctgcgcc

SEQ ID NO: 77 - DNA, 89 bp, Artificial Sequence
  Synthetic sequence-aptamer full sequence
taatacgactcactataggcgtagcctgatgagcctgctccatccgcgccagcctcaccgaaacgtggtgaaagccacgtagctgcgcc

SEQ ID NO: 78 - DNA, 89 bp, Artificial Sequence
  Synthetic sequence-aptamer full sequence
taatacgactcactataggcgtagcctgatgagccaatctcctgcccacgccgttccacgaaacgtggtgaaagccacgtagctgcgcc

SEQ ID NO: 79 - DNA, 89 bp, Artificial Sequence
  Synthetic sequence-aptamer full sequence
taatacgactcactataggcgtagcctgatgagccaatcaaggaccgccttcaccgctcgaaacgtggtgaaagccacgtagctgcgcc

SEQ ID NO: 80 - DNA, 89 bp, Artificial Sequence
  Synthetic sequence-aptamer full sequence
taatacgactcactataggcgtagcctgatgagactctcgcatcaccagccaactcaccgaaacgtggtgaaagccacgtagctgcgcc

SEQ ID NO: 81 - DNA, 25 bp, Artificial Sequence
  Synthetic sequence-aptamer core sequence
cggtactcagattacagagtgacat

SEQ ID NO: 82 - DNA, 24 bp, Artificial Sequence
  Synthetic sequence-aptamer core sequence
agacaccacggatccgaactggag

SEQ ID NO: 83 - DNA, 25 bp, Artificial Sequence
  Synthetic sequence-aptamer core sequence
cctcgcaagattgcatacgttagaa

SEQ ID NO: 84 - DNA, 25 bp, Artificial Sequence
  Synthetic sequence-aptamer core sequence
cacgtaggaaacgacctctacggag

SEQ ID NO: 85 - DNA, 26 bp, Artificial Sequence
  Synthetic sequence-aptamer core sequence
cccgaaaccaccaccgttgtccaata

SEQ ID NO: 86 - DNA, 89 bp, Artificial Sequence
  Synthetic sequence-aptamer full sequence
taatacgactcactataggcgtagcctgatgagcggtactcagattacagagtgacatcgaaacgtggtgaaagccacgtagctgcgcc

SEQ ID NO: 87 - DNA, 88 bp, Artificial Sequence
  Synthetic sequence-aptamer full sequence
taatacgactcactataggcgtagcctgatgagagacaccacggatccgaactggagcgaaacgtggtgaaagccacgtagctgcgcc

SEQ ID NO: 88 - DNA, 89 bp, Artificial Sequence
  Synthetic sequence-aptamer full sequence
taatacgactcactataggcgtagcctgatgagcctcgcaagattgcatacgttagaacgaaacgtggtgaaagccacgtagctgcgcc

SEQ ID NO: 89 - DNA, 89 bp, Artificial Sequence
  Synthetic sequence-aptamer full sequence
taatacgactcactataggcgtagcctgatgagcacgtaggaaacgacctctacggagcgaaacgtggtgaaagccacgtagctgcgcc

SEQ ID NO: 90 - DNA, 90 bp, Artificial Sequence
  Synthetic sequence-aptamer full sequence
taatacgactcactataggcgtagcctgatgagcccgaaaccaccaccgttgtccaatacgaaacgtggtgaaagccacgtagctgcgcc

SEQ ID NO: 91 - DNA, 40 bp, Artificial Sequence
  Synthetic sequence-aptamer sequence
ccagtctcccgtttaccgcgcctacacatgtctgaatgcc

SEQ ID NO: 92 - DNA, 40 bp, Artificial Sequence
  Synthetic sequence-aptamer sequence
ctaggcgaaatatagctacaactgtctgaaggcacccaat

SEQ ID NO: 93 - DNA, 42 bp, Artificial Sequence
  Synthetic sequence-aptamer sequence
atctacgaattcatcagggctaaagagtgcagagttacttag

SEQ ID NO: 94 - DNA, 40 bp, Artificial Sequence
  Synthetic sequence-aptamer sequence
gcagctaagcaggcggctcacaaaaccattcgcatgcggc

SEQ ID NO: 95 - RNA, 30 nt, Artificial Sequence
  Synthetic sequence-aptamer sequence
gguugugaagauugggagcgucguggcuac

SEQ ID NO: 96 - DNA, 80 bp, Artificial Sequence
  Synthetic sequence-aptamer sequence
tcgcacattccgcttctaccgggggggtcgagctgagtggatgcgaatctgtgggtgggccgtaagtccgtgtgtgcgaa

SEQ ID NO: 97 - DNA, 30 bp, Artificial Sequence
  Synthetic sequence-aptamer unique sequence
ggcctgcgatggatgtgtgcgtgtattagc

SEQ ID NO: 98 - DNA, 30 bp, Artificial Sequence
  Synthetic sequence-aptamer unique sequence
gtacgcgctctggatgtggtttgttagtct

SEQ ID NO: 99 - DNA, 30 bp, Artificial Sequence
  Synthetic sequence-aptamer unique sequence
ggccggcgatggatgtggttgtgcttgttt

SEQ ID NO: 100 - DNA, 30 bp, Artificial Sequence
  Synthetic sequence-aptamer unique sequence
gtgcgaccgaccctatcaggtgctcatgta

SEQ ID NO: 101 - DNA, 30 bp, Artificial Sequence
  Synthetic sequence-aptamer unique sequence
ggccgcgtctggatgtggttttgtcgcgtc

SEQ ID NO: 102 - DNA, 30 bp, Artificial Sequence
  Synthetic sequence-aptamer unique sequence
gtccgacgatggatgtggatgtattggtct

SEQ ID NO: 103 - DNA, 30 bp, Artificial Sequence
  Synthetic sequence-aptamer unique sequence
ggcctgcgatggatgtgggctagtatgggc

SEQ ID NO: 104 - DNA, 30 bp, Artificial Sequence
  Synthetic sequence-aptamer unique sequence
gttccgccgatggatgtgggtgtagttgtc

SEQ ID NO: 105 - DNA, 30 bp, Artificial Sequence
  Synthetic sequence-aptamer unique sequence
ggcattcgatggatggggtggtgttagtct

SEQ ID NO: 106 - DNA, 30 bp, Artificial Sequence
  Synthetic sequence-aptamer unique sequence
gtccgcagctggatgggggagtgtctggtt

SEQ ID NO: 107 - DNA, 30 bp, Artificial Sequence
  Synthetic sequence-aptamer unique sequence
gtcagtcgatggatgtgggttgtgctcgtc

SEQ ID NO: 108 - DNA, 30 bp, Artificial Sequence
  Synthetic sequence-aptamer unique sequence
gtacgacgcggaccttcaagtaggcgtgta

SEQ ID NO: 109 - DNA, 30 bp, Artificial Sequence
  Synthetic sequence-aptamer unique sequence
ggcctcgaagcccttcaagcggttcatgga

SEQ ID NO: 110 - DNA, 30 bp, Artificial Sequence
  Synthetic sequence-aptamer unique sequence
ggccgatctggatgggggctcgggcgagtc

SEQ ID NO: 111 - DNA, 30 bp, Artificial Sequence
  Synthetic sequence-aptamer unique sequence
ggcctgcgatggatgaggtgctgcactagt

SEQ ID NO: 112 - DNA, 30 bp, Artificial Sequence
  Synthetic sequence-aptamer unique sequence
gtacgcgctctggatgtggttggttagtct

SEQ ID NO: 113 - DNA, 30 bp, Artificial Sequence
  Synthetic sequence-aptamer unique sequence
ggccgccgatggatgttggcattgctggtc

SEQ ID NO: 114 - DNA, 30 bp, Artificial Sequence
  Synthetic sequence-aptamer unique sequence
ggccgatctggatggggtatgtgtctaggc

SEQ ID NO: 115 - DNA, 30 bp, Artificial Sequence
  Synthetic sequence-aptamer unique sequence
gtccgtcgatggatggggttgggttcagtc

SEQ ID NO: 116 - DNA, 30 bp, Artificial Sequence
  Synthetic sequence-aptamer unique sequence
gtgcttggatccctatcaggtggacgtgta

SEQ ID NO: 117 - DNA, 30 bp, Artificial Sequence
  Synthetic sequence-aptamer unique sequence
gtcgttcgatggatgtgtgctgtatgagtc

SEQ ID NO: 118 - DNA, 30 bp, Artificial Sequence
  Synthetic sequence-aptamer unique sequence
gtccgacgatgggtgggggaatgcgacggc

SEQ ID NO: 119 - DNA, 30 bp, Artificial Sequence
  Synthetic sequence-aptamer unique sequence
gtgcgccgatgggtgtgtgtcgtggctggt

SEQ ID NO: 120 - DNA, 30 bp, Artificial Sequence
  Synthetic sequence-aptamer unique sequence
gtcctgatctgggtgtgggggtgtgcaggc

SEQ ID NO: 121 - DNA, 30 bp, Artificial Sequence
  Synthetic sequence-aptamer unique sequence
ggcctgactgggtgtgggtagttacttggc

SEQ ID NO: 122 - DNA, 30 bp, Artificial Sequence
  Synthetic sequence-aptamer unique sequence
ggacgcatcgccccttcgagtggacaggta

SEQ ID NO: 123 - DNA, 30 bp, Artificial Sequence
  Synthetic sequence-aptamer unique sequence
ggcctgactgggtgtggttaggaacgcgtc

SEQ ID NO: 124 - DNA, 30 bp, Artificial Sequence
  Synthetic sequence-aptamer unique sequence
gtcatgcgatggatgggggctggcagtcgt

SEQ ID NO: 125 - DNA, 30 bp, Artificial Sequence
  Synthetic sequence-aptamer unique sequence
aatgtggcgggatctggatgtgtgcatgta

SEQ ID NO: 126 - DNA, 30 bp, Artificial Sequence
  Synthetic sequence-aptamer unique sequence
ggcctggtctggatgggggcgggtataggc

SEQ ID NO: 127 - DNA, 30 bp, Artificial Sequence
  Synthetic sequence-aptamer unique sequence
ggcctgggatggatgtggtgtattaggctg

SEQ ID NO: 128 - DNA, 30 bp, Artificial Sequence
  Synthetic sequence-aptamer unique sequence
gcccgactctggatgggggaatgcgcagtc

SEQ ID NO: 129 - DNA, 30 bp, Artificial Sequence
  Synthetic sequence-aptamer unique sequence
gtcgtgctctgggtggggttgtgtagtagt

SEQ ID NO: 130 - DNA, 30 bp, Artificial Sequence
  Synthetic sequence-aptamer unique sequence
gtcattcgctggatgtgttgatgtctggtc

SEQ ID NO: 131 - DNA, 30 bp, Artificial Sequence
  Synthetic sequence-aptamer unique sequence
ggccggcgatggatgtgtatgtggtagtcg

SEQ ID NO: 132 - DNA, 30 bp, Artificial Sequence
  Synthetic sequence-aptamer unique sequence
ggacgcggctggatgggggcttgcactgtc

SEQ ID NO: 133 - DNA, 30 bp, Artificial Sequence
  Synthetic sequence-aptamer unique sequence
ggccggcgatggatgtgtgcgtgtattagc

SEQ ID NO: 134 - DNA, 30 bp, Artificial Sequence
  Synthetic sequence-aptamer unique sequence
ggccgccgatgggtgtggaggtgtacttgt

SEQ ID NO: 135 - DNA, 30 bp, Artificial Sequence
  Synthetic sequence-aptamer unique sequence
ggcctgcgatggatgtggttgtgcttgttt

SEQ ID NO: 136 - DNA, 30 bp, Artificial Sequence
  Synthetic sequence-aptamer unique sequence
ggccgacgatggcgtagcgtctgtactgtt

SEQ ID NO: 137 - DNA, 30 bp, Artificial Sequence
  Synthetic sequence-aptamer unique sequence
ggccgtgtctgggtgggggtatgcactgtc

SEQ ID NO: 138 - DNA, 30 bp, Artificial Sequence
  Synthetic sequence-aptamer unique sequence
ggccggcgatggatgtgaaatggcttgtct

SEQ ID NO: 139 - DNA, 30 bp, Artificial Sequence
  Synthetic sequence-aptamer unique sequence
ggccgcgtctgggtgttggttgtgttaggc

SEQ ID NO: 140 - DNA, 30 bp, Artificial Sequence
  Synthetic sequence-aptamer unique sequence
ggacagcgatggatgtggaaatgcgacgtc

SEQ ID NO: 141 - DNA, 30 bp, Artificial Sequence
  Synthetic sequence-aptamer unique sequence
ggactgcgcgtgacctatcaatggcatgta

SEQ ID NO: 142 - DNA, 30 bp, Artificial Sequence
  Synthetic sequence-aptamer unique sequence
ggccagctctggatgaggtctgtgcgaggc

SEQ ID NO: 143 - DNA, 30 bp, Artificial Sequence
  Synthetic sequence-aptamer unique sequence
gtccgaccgcacccttcgaggggacatgga

SEQ ID NO: 144 - DNA, 30 bp, Artificial Sequence
  Synthetic sequence-aptamer unique sequence
ggccaatgcgccccttcatgttgtcgtgta

SEQ ID NO: 145 - DNA, 30 bp, Artificial Sequence
  Synthetic sequence-aptamer unique sequence
ggccggctataccctacacgtgatcaggta

SEQ ID NO: 146 - DNA, 30 bp, Artificial Sequence
  Synthetic sequence-aptamer unique sequence
gtgcgcacgatggatgtggatggccagtct

SEQ ID NO: 147 - DNA, 30 bp, Artificial Sequence
  Synthetic sequence-aptamer unique sequence
ggcatgcgatggatgggggctggggcagtc

SEQ ID NO: 148 - DNA, 30 bp, Artificial Sequence
  Synthetic sequence-aptamer unique sequence
gtcatgcgctggatgtgggttgttataggc

SEQ ID NO: 149 - DNA, 30 bp, Artificial Sequence
  Synthetic sequence-aptamer unique sequence
gtgcgcctctggatggggtttgtcgacggc

SEQ ID NO: 150 - DNA, 30 bp, Artificial Sequence
  Synthetic sequence-aptamer unique sequence
ggccagctctggatgtggcattgtctggtc

SEQ ID NO: 151 - DNA, 30 bp, Artificial Sequence
  Synthetic sequence-aptamer unique sequence
ggcctgagctggcattgcgctggacatgta

SEQ ID NO: 152 - DNA, 30 bp, Artificial Sequence
  Synthetic sequence-aptamer unique sequence
ggccgccgatgggtgtgggatcgtgcgggc

SEQ ID NO: 153 - DNA, 30 bp, Artificial Sequence
  Synthetic sequence-aptamer unique sequence
ggccgacgctgggtgggggcgttgactagt

SEQ ID NO: 154 - DNA, 30 bp, Artificial Sequence
  Synthetic sequence-aptamer unique sequence
ggactacgctggatggggacattgctagtt

SEQ ID NO: 155 - DNA, 30 bp, Artificial Sequence
  Synthetic sequence-aptamer unique sequence
ggcatgcgatgggtgtgttctggcgacggc

SEQ ID NO: 156 - DNA, 30 bp, Artificial Sequence
  Synthetic sequence-aptamer unique sequence
ggactacgctggatgtgggttggggtagtc

SEQ ID NO: 157 - DNA, 30 bp, Artificial Sequence
  Synthetic sequence-aptamer unique sequence
ggccgagcttacctgtcaagtgcgagtgta

SEQ ID NO: 158 - DNA, 30 bp, Artificial Sequence
  Synthetic sequence-aptamer unique sequence
gtgcttcgatggatgtgggcgttgcaagtc

SEQ ID NO: 159 - DNA, 30 bp, Artificial Sequence
  Synthetic sequence-aptamer unique sequence
gtccgcggctgggtgtgggaagtactcggc

SEQ ID NO: 160 - DNA, 30 bp, Artificial Sequence
  Synthetic sequence-aptamer unique sequence
gtccgcgcgatggatgaggacgtgagctag

SEQ ID NO: 161 - DNA, 30 bp, Artificial Sequence
  Synthetic sequence-aptamer unique sequence
ggccgagtcgtcacttcaattgggcgtgga

SEQ ID NO: 162 - DNA, 30 bp, Artificial Sequence
  Synthetic sequence-aptamer unique sequence
gtcggtcggagggatggtctcgttgacggc

SEQ ID NO: 163 - DNA, 30 bp, Artificial Sequence
  Synthetic sequence-aptamer unique sequence
ggccacacgctgccctaaagtgttcgtgta

SEQ ID NO: 164 - DNA, 30 bp, Artificial Sequence
  Synthetic sequence-aptamer unique sequence
ggcctgcgatggatgtgtgcgtgtattagt

SEQ ID NO: 165 - DNA, 30 bp, Artificial Sequence
  Synthetic sequence-aptamer unique sequence
gtgcgctgtcttgcctacaagtgtcgtgta

SEQ ID NO: 166 - DNA, 30 bp, Artificial Sequence
  Synthetic sequence-aptamer unique sequence
ggccgaactggatgggggcattactgcggc

SEQ ID NO: 167 - DNA, 30 bp, Artificial Sequence
  Synthetic sequence-aptamer unique sequence
ggccgagctggatggggtattggatctagt

SEQ ID NO: 168 - DNA, 30 bp, Artificial Sequence
  Synthetic sequence-aptamer unique sequence
tggccgcactctgggtgtggtggacttggc

SEQ ID NO: 169 - DNA, 30 bp, Artificial Sequence
  Synthetic sequence-aptamer unique sequence
ggccggtctggatgggggcgtacgtcgtcg

SEQ ID NO: 170 - DNA, 30 bp, Artificial Sequence
  Synthetic sequence-aptamer unique sequence
ggcctgctatgggtgggggctcgtactggc

SEQ ID NO: 171 - DNA, 30 bp, Artificial Sequence
  Synthetic sequence-aptamer unique sequence
gtacgcccgatggatgtggattgtactgtt

SEQ ID NO: 172 - DNA, 30 bp, Artificial Sequence
  Synthetic sequence-aptamer unique sequence
ggcctgcgatggatgtgggccagtacgcgc

SEQ ID NO: 173 - DNA, 30 bp, Artificial Sequence
  Synthetic sequence-aptamer unique sequence
gacctgcgatgggtgtggctctgtcagtct

SEQ ID NO: 174 - DNA, 30 bp, Artificial Sequence
  Synthetic sequence-aptamer unique sequence
gtccgaactggatgtggtattggcctgtct

SEQ ID NO: 175 - DNA, 30 bp, Artificial Sequence
  Synthetic sequence-aptamer unique sequence
gttcttgtctggatggggttgatgtcggtc

SEQ ID NO: 176 - DNA, 30 bp, Artificial Sequence
  Synthetic sequence-aptamer unique sequence
gtactcgatgggtgtgggtaggcgcgagtc

SEQ ID NO: 177 - DNA, 30 bp, Artificial Sequence
  Synthetic sequence-aptamer unique sequence
gtcctcgatgggtgtgagatatgtgctagc

SEQ ID NO: 178 - DNA, 30 bp, Artificial Sequence
  Synthetic sequence-aptamer unique sequence
ggccgtgctctgggtgtgggcctgctgggc

SEQ ID NO: 179 - DNA, 30 bp, Artificial Sequence
  Synthetic sequence-aptamer unique sequence
gttcgtatctgggtgtggtgtgtctgggct

SEQ ID NO: 180 - DNA, 30 bp, Artificial Sequence
  Synthetic sequence-aptamer unique sequence
ggccgagtctggatgtgtgtcgtacgtatc

SEQ ID NO: 181 - DNA, 30 bp, Artificial Sequence
  Synthetic sequence-aptamer unique sequence
ggcgttcactgggtgtggatgtgtgcggtc

SEQ ID NO: 182 - DNA, 30 bp, Artificial Sequence
  Synthetic sequence-aptamer unique sequence
gtcatgcgctgggtgtggcctgttgtaggc

SEQ ID NO: 183 - DNA, 30 bp, Artificial Sequence
  Synthetic sequence-aptamer unique sequence
gctccgtacgatggctgtgctggtgatgta

SEQ ID NO: 184 - DNA, 30 bp, Artificial Sequence
  Synthetic sequence-aptamer unique sequence
ggactgcgatgggtggggttatgtgccagc

SEQ ID NO: 185 - DNA, 30 bp, Artificial Sequence
  Synthetic sequence-aptamer unique sequence
gtgcgatcgtacctatcaatggtcatcgta

SEQ ID NO: 186 - DNA, 30 bp, Artificial Sequence
  Synthetic sequence-aptamer unique sequence
gttcgtcgaatggatgtgagcatgtctgtc

SEQ ID NO: 187 - DNA, 30 bp, Artificial Sequence
  Synthetic sequence-aptamer unique sequence
ggccgtacgatggatgtgggatggtctagc

SEQ ID NO: 188 - DNA, 30 bp, Artificial Sequence
  Synthetic sequence-aptamer unique sequence
gtcattaactggatgtgggactgtcggtct

SEQ ID NO: 189 - DNA, 30 bp, Artificial Sequence
  Synthetic sequence-aptamer unique sequence
ggacgatctgggtgtggacagggatgaggc

SEQ ID NO: 190 - DNA, 30 bp, Artificial Sequence
  Synthetic sequence-aptamer unique sequence
ggcatgcgatggatgtggtgtacccagtcc

SEQ ID NO: 191 - DNA, 30 bp, Artificial Sequence
  Synthetic sequence-aptamer unique sequence
ggccgcgatggatgtggaaaggtctagtca

SEQ ID NO: 192 - DNA, 30 bp, Artificial Sequence
  Synthetic sequence-aptamer unique sequence
ggccgacctggatgtgagcatgcatctagt

SEQ ID NO: 193 - DNA, 30 bp, Artificial Sequence
  Synthetic sequence-aptamer unique sequence
gtacgagcggaccgatcaagtgcgtctgta

SEQ ID NO: 194 - DNA, 30 bp, Artificial Sequence
  Synthetic sequence-aptamer unique sequence
gtactgcactgccctacacgtgggaatgga

SEQ ID NO: 195 - DNA, 30 bp, Artificial Sequence
  Synthetic sequence-aptamer unique sequence
gtcattcgatggatgtggcgtgtgcgtcat

SEQ ID NO: 196 - DNA, 30 bp, Artificial Sequence
  Synthetic sequence-aptamer unique sequence
ggcgtacgatggatgtgcgttgtgtctgtc

SEQ ID NO: 197 - DNA, 30 bp, Artificial Sequence; identical to SEQ ID NO: 97
  Synthetic sequence-aptamer unique sequence

SEQ ID NO: 198 - DNA, 30 bp, Artificial Sequence
  Synthetic sequence-aptamer unique sequence
gtcattccgcatcctacacgtgggcacgta

SEQ ID NO: 199 - DNA, 30 bp, Artificial Sequence; identical to SEQ ID NO: 144
  Synthetic sequence-aptamer unique sequence

SEQ ID NO: 200 - DNA, 30 bp, Artificial Sequence; identical to SEQ ID NO: 111
  Synthetic sequence-aptamer unique sequence

SEQ ID NO: 201 - DNA, 30 bp, Artificial Sequence; identical to SEQ ID NO: 107
  Synthetic sequence-aptamer unique sequence

SEQ ID NO: 202 - DNA, 30 bp, Artificial Sequence
  Synthetic sequence-aptamer unique sequence
gtcgtgactggctagctggacatgcactgc

SEQ ID NO: 203 - DNA, 30 bp, Artificial Sequence; identical to SEQ ID NO: 103
  Synthetic sequence-aptamer unique sequence

SEQ ID NO: 204 - DNA, 30 bp, Artificial Sequence
  Synthetic sequence-aptamer unique sequence
gtgcatcgatggcgtatgctggtgatgtgc

SEQ ID NO: 205 - DNA, 30 bp, Artificial Sequence
  Synthetic sequence-aptamer unique sequence
gcgacagcgacatacgatctgctctgcgtc

SEQ ID NO: 206 - DNA, 30 bp, Artificial Sequence
  Synthetic sequence-aptamer unique sequence
gtcatgccatcccttcgagtgtgacaggta

SEQ ID NO: 207 - DNA, 30 bp, Artificial Sequence; identical to SEQ ID NO: 123
  Synthetic sequence-aptamer unique sequence

SEQ ID NO: 208 - DNA, 30 bp, Artificial Sequence; identical to SEQ ID NO: 146
  Synthetic sequence-aptamer unique sequence

SEQ ID NO: 209 - DNA, 30 bp, Artificial Sequence; identical to SEQ ID NO: 119
  Synthetic sequence-aptamer unique sequence

SEQ ID NO: 210 - DNA, 30 bp, Artificial Sequence; identical to SEQ ID NO: 190
  Synthetic sequence-aptamer unique sequence

SEQ ID NO: 211 - DNA, 30 bp, Artificial Sequence
  Synthetic sequence-aptamer unique sequence
ccatatggcagtgcgatggcttcgctggtc

SEQ ID NO: 212 - DNA, 30 bp, Artificial Sequence; identical to SEQ ID NO: 183
  Synthetic sequence-aptamer unique sequence

SEQ ID NO: 213 - DNA, 30 bp, Artificial Sequence; identical to SEQ ID NO: 100
  Synthetic sequence-aptamer unique sequence

SEQ ID NO: 214 - DNA, 30 bp, Artificial Sequence; identical to SEQ ID NO: 104
  Synthetic sequence-aptamer unique sequence

SEQ ID NO: 215 - DNA, 30 bp, Artificial Sequence; identical to SEQ ID NO: 194
  Synthetic sequence-aptamer unique sequence

SEQ ID NO: 216 - DNA, 30 bp, Artificial Sequence
  Synthetic sequence-aptamer unique sequence
cgcaccgtcgatacgtcatgcacgctgaca

SEQ ID NO: 217 - DNA, 30 bp, Artificial Sequence
  Synthetic sequence-aptamer unique sequence
gtacgcacgatgagcgccaagtgacatgga

SEQ ID NO: 218 - DNA, 30 bp, Artificial Sequence; identical to SEQ ID NO: 162
  Synthetic sequence-aptamer unique sequence

SEQ ID NO: 219 - DNA, 30 bp, Artificial Sequence
  Synthetic sequence-aptamer unique sequence
ggcatgcgatgaacgaggcatgatgcgtca

SEQ ID NO: 220 - DNA, 30 bp, Artificial Sequence; identical to SEQ ID NO: 196
  Synthetic sequence-aptamer unique sequence

SEQ ID NO: 221 - DNA, 30 bp, Artificial Sequence
  Synthetic sequence-aptamer unique sequence
gtcactgtgcctgaccgtcaagttgcggca

SEQ ID NO: 222 - DNA, 30 bp, Artificial Sequence; identical to SEQ ID NO: 141
  Synthetic sequence-aptamer unique sequence

SEQ ID NO: 223 - DNA, 30 bp, Artificial Sequence; identical to SEQ ID NO: 151
  Synthetic sequence-aptamer unique sequence

SEQ ID NO: 224 - DNA, 30 bp, Artificial Sequence
  Synthetic sequence-aptamer unique sequence
gcattggacgatcgtgccctacacgtgggc

SEQ ID NO: 225 - DNA, 30 bp, Artificial Sequence; identical to SEQ ID NO: 122
  Synthetic sequence-aptamer unique sequence

SEQ ID NO: 226 - DNA, 30 bp, Artificial Sequence; identical to SEQ ID NO: 163
  Synthetic sequence-aptamer unique sequence

SEQ ID NO: 227 - DNA, 30 bp, Artificial Sequence
  Synthetic sequence-aptamer unique sequence
gttctgactgggtgtggtgctgcactgtca

SEQ ID NO: 228 - DNA, 30 bp, Artificial Sequence
  Synthetic sequence-aptamer unique sequence
ggcaacgcacatcgtatcacgcatcggacc

SEQ ID NO: 229 - DNA, 30 bp, Artificial Sequence
  Synthetic sequence-aptamer unique sequence
gtcatgcgcggacattcaagttggcgtgga

SEQ ID NO: 230 - DNA, 30 bp, Artificial Sequence
  Synthetic sequence-aptamer unique sequence
ccgtagcgacatcaagcggtggtgtgcgtg

SEQ ID NO: 231 - DNA, 30 bp, Artificial Sequence; identical to SEQ ID NO: 108
  Synthetic sequence-aptamer unique sequence

SEQ ID NO: 232 - DNA, 30 bp, Artificial Sequence
  Synthetic sequence-aptamer unique sequence
gacctgactgtgcctatcgagtgcgtgatg

SEQ ID NO: 233 - DNA, 30 bp, Artificial Sequence
  Synthetic sequence-aptamer unique sequence
tggccgatcgaccctatcaagtgcagcatg

SEQ ID NO: 234 - DNA, 30 bp, Artificial Sequence
  Synthetic sequence-aptamer unique sequence
gttccgagctggatgtggcctgtgctatgc

SEQ ID NO: 235 - DNA, 30 bp, Artificial Sequence
  Synthetic sequence-aptamer unique sequence
ggcatgcgatggatgtgtgcgtgtattagc

SEQ ID NO: 236 - DNA, 30 bp, Artificial Sequence
  Synthetic sequence-aptamer unique sequence
gtacgcatcgtcccgtcatgtggttccgta

SEQ ID NO: 237 - DNA, 30 bp, Artificial Sequence
  Synthetic sequence-aptamer unique sequence
ggcattgcgcgcctagcaagttgacgtgta

SEQ ID NO: 238 - DNA, 30 bp, Artificial Sequence
  Synthetic sequence-aptamer unique sequence
ggacgcacgcagaccttcaagtcggccatg

SEQ ID NO: 239 - DNA, 30 bp, Artificial Sequence
  Synthetic sequence-aptamer unique sequence
gtgctgcatgagcggtgtgcgtgtacgacg

SEQ ID NO: 240 - DNA, 30 bp, Artificial Sequence
  Synthetic sequence-aptamer unique sequence
gtcatgctcgcactatcaggtgtgcatgga

SEQ ID NO: 241 - DNA, 30 bp, Artificial Sequence
  Synthetic sequence-aptamer unique sequence
gtgcgcggcttgccttcacgtgatcgtgta

SEQ ID NO: 242 - DNA, 30 bp, Artificial Sequence
  Synthetic sequence-aptamer unique sequence
gtcatacgatgggtgtggtatgtgtacgta

SEQ ID NO: 243 - DNA, 30 bp, Artificial Sequence
  Synthetic sequence-aptamer unique sequence
gcatgcgttggacttgtctggctgtgggtg

SEQ ID NO: 244 - DNA, 30 bp, Artificial Sequence
  Synthetic sequence-aptamer unique sequence
tgcgtcgtatgtgcggctcggatgtgtgtc

SEQ ID NO: 245 - DNA, 30 bp, Artificial Sequence
  Synthetic sequence-aptamer unique sequence
ggacgcagcttgcctactggtggtcacgta

SEQ ID NO: 246 - DNA, 30 bp, Artificial Sequence
  Synthetic sequence-aptamer unique sequence
ggccatcgatgggtgtggctgtacttgaca

SEQ ID NO: 247 - DNA, 30 bp, Artificial Sequence
  Synthetic sequence-aptamer unique sequence
gcgtgtcagcaatacgtcctcatctgcccg

SEQ ID NO: 248 - DNA, 30 bp, Artificial Sequence; identical to SEQ ID NO: 185
  Synthetic sequence-aptamer unique sequence

SEQ ID NO: 249 - DNA, 30 bp, Artificial Sequence; identical to SEQ ID NO: 147
  Synthetic sequence-aptamer unique sequence

SEQ ID NO: 250 - DNA, 30 bp, Artificial Sequence; identical to SEQ ID NO: 136
  Synthetic sequence-aptamer unique sequence

SEQ ID NO: 251 - DNA, 30 bp, Artificial Sequence
  Synthetic sequence-aptamer unique sequence
tggccgatcatccctcaagttggcgtgtgc

SEQ ID NO: 252 - DNA, 30 bp, Artificial Sequence; identical to SEQ ID NO: 187
  Synthetic sequence-aptamer unique sequence

SEQ ID NO: 253 - DNA, 30 bp, Artificial Sequence
  Synthetic sequence-aptamer unique sequence
ggcacaaacggaccgacaagtgcgcatgga

SEQ ID NO: 254 - DNA, 30 bp, Artificial Sequence
  Synthetic sequence-aptamer unique sequence
gtacggaacggaacaacaagggcaggcatg

SEQ ID NO: 255 - DNA, 30 bp, Artificial Sequence
  Synthetic sequence-aptamer unique sequence
ggacgcacatcccgttcatgtgtgcatgta

SEQ ID NO: 256 - DNA, 30 bp, Artificial Sequence
  Synthetic sequence-aptamer unique sequence
ggccaagctggatgtgttcaggtcacgacg

SEQ ID NO: 257 - DNA, 25 bp, Artificial Sequence
  Synthetic sequence-aptamer unique sequence
ggcctgcgatggatgtgtgcgtgta

SEQ ID NO: 258 - DNA, 30 bp, Artificial Sequence
  Synthetic sequence-aptamer unique sequence
cgtgcgcgagacatggtccatcggttcgtg

SEQ ID NO: 259 - DNA, 30 bp, Artificial Sequence; identical to SEQ ID NO: 182
  Synthetic sequence-aptamer unique sequence

SEQ ID NO: 260 - DNA, 30 bp, Artificial Sequence
  Synthetic sequence-aptamer unique sequence
gtcgcgatgagctagcatgtgcgttgtgta

SEQ ID NO: 261 - DNA, 30 bp, Artificial Sequence
  Synthetic sequence-aptamer unique sequence
gtgctacgatggctgtgggcgtgatgcgta

SEQ ID NO: 262 - DNA, 30 bp, Artificial Sequence
  ASynthetic sequence-aptamer unique sequence
gacgctgcgttccctatcatgtgcggcatg

SEQ ID NO: 263 - DNA, 30 bp, Artificial Sequence
  Synthetic sequence-aptamer unique sequence
gttcgcgcgacacctatcaatgtggacgtg

SEQ ID NO: 264 - DNA, 30 bp, Artificial Sequence
  Synthetic sequence-aptamer unique sequence
gcacgactcgcaccctatcatgaggccatg

SEQ ID NO: 265 - DNA, 30 bp, Artificial Sequence
  Synthetic sequence-aptamer unique sequence
gtcatgaaacgagcctacacgtggtgcatg

SEQ ID NO: 266 - DNA, 30 bp, Artificial Sequence
  Synthetic sequence-aptamer unique sequence
ggacgcgatgggcgtgggtatgcacttggc

SEQ ID NO: 267 - DNA, 31 bp, Artificial Sequence
  Synthetic sequence-aptamer unique sequence
gtactgcgatggcttagcaaagtgcgacatg

SEQ ID NO: 268 - DNA, 30 bp, Artificial Sequence
  Synthetic sequence-aptamer unique sequence
tgccctggcaatgcgatgttcgatgcgacc

SEQ ID NO: 269 - DNA, 30 bp, Artificial Sequence
  Synthetic sequence-aptamer unique sequence
gtacgcgacgtccctgagagtgtgcaggta

SEQ ID NO: 270 - DNA, 30 bp, Artificial Sequence
  Synthetic sequence-aptamer unique sequence
gtgcgccgatatcccttcacagttggcatg

SEQ ID NO: 271 - DNA, 30 bp, Artificial Sequence
  Synthetic sequence-aptamer unique sequence
ggccgacgatggatgggaggcatgactggc

SEQ ID NO: 272 - DNA, 30 bp, Artificial Sequence
  Synthetic sequence-aptamer unique sequence
gtacgcgctggtcccgtatcatgtgcgtca

SEQ ID NO: 273 - DNA, 28 bp, Artificial Sequence
  Synthetic sequence-aptamer unique sequence
ggcctcgatggatgtggtggtgctgtca

SEQ ID NO: 274 - DNA, 30 bp, Artificial Sequence; identical to SEQ ID NO: 166
  Synthetic sequence-aptamer unique sequence

SEQ ID NO: 275 - DNA, 30 bp, Artificial Sequence
  Synthetic sequence-aptamer unique sequence
gtcacggaacgaagcctatcaagtgcgaca

SEQ ID NO: 276 - DNA, 30 bp, Artificial Sequence
  Synthetic sequence-aptamer unique sequence
ggcacggaggatggacgttctgccttggtc

SEQ ID NO: 277 - DNA, 30 bp, Artificial Sequence
  Synthetic sequence-aptamer unique sequence
gcaactgcacgcattggaccgcacgtcaca

SEQ ID NO: 278 - DNA, 30 bp, Artificial Sequence
  Synthetic sequence-aptamer unique sequence
gtgctgagctgggagtggtggtgctttggc

SEQ ID NO: 279 - DNA, 30 bp, Artificial Sequence
  Synthetic sequence-aptamer unique sequence
gtctgccgatggatgtggtgtacgcagacg

SEQ ID NO: 280 - DNA, 30 bp, Artificial Sequence
  Synthetic sequence-aptamer unique sequence
gtacacgatgcaccttcaagttgtgatgta

SEQ ID NO: 281 - DNA, 30 bp, Artificial Sequence
  Synthetic sequence-aptamer unique sequence
ggacgcgtcgaccttcaagtgtgccgtgga

SEQ ID NO: 282 - DNA, 30 bp, Artificial Sequence; identical to SEQ ID NO: 130
  Synthetic sequence-aptamer unique sequence

SEQ ID NO: 283 - DNA, 30 bp, Artificial Sequence
  Synthetic sequence-aptamer unique sequence
cgcatgggacgtactgaccggatcgtgtca

SEQ ID NO: 284 - DNA, 30 bp, Artificial Sequence
  Synthetic sequence-aptamer unique sequence
ggccacgatggatgaggacatgactggttg

SEQ ID NO: 285 - DNA, 30 bp, Artificial Sequence
  Synthetic sequence-aptamer unique sequence
gtgcgacacgtgttcccgttcaagttgggc

SEQ ID NO: 286 - DNA, 30 bp, Artificial Sequence
  Synthetic sequence-aptamer unique sequence
cacgacagcgttagcaggccatgcgacacg

SEQ ID NO: 287 - DNA, 30 bp, Artificial Sequence
  Synthetic sequence-aptamer unique sequence
gtcgtgcgtgccctatcaagtcggtctgta

SEQ ID NO: 288 - DNA, 30 bp, Artificial Sequence; identical to SEQ ID NO: 155
  Synthetic sequence-aptamer unique sequence

SEQ ID NO: 289 - DNA, 30 bp, Artificial Sequence
  Synthetic sequence-aptamer unique sequence
gtctgagcgcaacctcgtggactgtgcgtg

SEQ ID NO: 290 - DNA, 30 bp, Artificial Sequence; identical to SEQ ID NO: 101
  Synthetic sequence-aptamer unique sequence

SEQ ID NO: 291 - DNA, 29 bp, Artificial Sequence
  Synthetic sequence-aptamer unique sequence
ccgtgttgcgtgtccagtctcgttgcgcg

SEQ ID NO: 292 - DNA, 30 bp, Artificial Sequence; identical to SEQ ID NO: 99
  Synthetic sequence-aptamer unique sequence

SEQ ID NO: 293 - DNA, 29 bp, Artificial Sequence
  Synthetic sequence-aptamer unique sequence
gtgcgatacatcccaacctcccgtgtggc

SEQ ID NO: 294 - DNA, 30 bp, Artificial Sequence
  Synthetic sequence-aptamer unique sequence
gccgcaacgactgaggggtgtatgtacgcg

SEQ ID NO: 295 - DNA, 30 bp, Artificial Sequence
  Synthetic sequence-aptamer unique sequence
ggacgcggatgagcttcgagtgacgtgtac

SEQ ID NO: 296 - DNA, 30 bp, Artificial Sequence
  Synthetic sequence-aptamer unique sequence
gtcgtgactggcgtagctggtagtgctagg

SEQ ID NO: 297 - DNA, 76 bp, Artificial Sequence
  Synthetic sequence-aptamer full sequence
tagggaagagaaggacatatgatggcctgcgatggatgtgtgcgtgtattagcttgactagtacatgaccacttga

SEQ ID NO: 298 - DNA, 76 bp, Artificial Sequence
  Synthetic sequence-aptamer full sequence
tagggaagagaaggacatatgatgtacgcgctctggatgtggtttgttagtctttgactagtacatgaccacttga

SEQ ID NO: 299 - DNA, 76 bp, Artificial Sequence
  Synthetic sequence-aptamer full sequence
tagggaagagaaggacatatgatggccggcgatggatgtggttgtgcttgtttttgactagtacatgaccacttga

SEQ ID NO: 300 - DNA, 76 bp, Artificial Sequence
  Synthetic sequence-aptamer full sequence
tagggaagagaaggacatatgatgtgcgaccgaccctatcaggtgctcatgtattgactagtacatgaccacttga

SEQ ID NO: 301 - DNA, 76 bp, Artificial Sequence
  Synthetic sequence-aptamer full sequence
tagggaagagaaggacatatgatggccgcgtctggatgtggttttgtcgcgtcttgactagtacatgaccacttga

SEQ ID NO: 302 - DNA, 76 bp, Artificial Sequence
  Synthetic sequence-aptamer full sequence
tagggaagagaaggacatatgatgtccgacgatggatgtggatgtattggtctttgactagtacatgaccacttga

SEQ ID NO: 303 - DNA, 76 bp, Artificial Sequence
  Synthetic sequence-aptamer full sequence
tagggaagagaaggacatatgatggcctgcgatggatgtgggctagtatgggcttgactagtacatgaccacttga

SEQ ID NO: 304 - DNA, 76 bp, Artificial Sequence
  Synthetic sequence-aptamer full sequence
tagggaagagaaggacatatgatgttccgccgatggatgtgggtgtagttgtcttgactagtacatgaccacttga

SEQ ID NO: 305 - DNA, 76 bp, Artificial Sequence
  Synthetic sequence-aptamer full sequence
tagggaagagaaggacatatgatggcattcgatggatggggtggtgttagtctttgactagtacatgaccacttga

SEQ ID NO: 306 - DNA, 76 bp, Artificial Sequence
  Synthetic sequence-aptamer full sequence
tagggaagagaaggacatatgatgtccgcagctggatgggggagtgtctggttttgactagtacatgaccacttga

SEQ ID NO: 307 - DNA, 76 bp, Artificial Sequence
  Synthetic sequence-aptamer full sequence
tagggaagagaaggacatatgatgtcagtcgatggatgtgggttgtgctcgtcttgactagtacatgaccacttga

SEQ ID NO: 308 - DNA, 76 bp, Artificial Sequence
  Synthetic sequence-aptamer full sequence
tagggaagagaaggacatatgatgtacgacgcggaccttcaagtaggcgtgtattgactagtacatgaccacttga

SEQ ID NO: 309 - DNA, 76 bp, Artificial Sequence
  Synthetic sequence-aptamer full sequence
tagggaagagaaggacatatgatggcctcgaagcccttcaagcggttcatggattgactagtacatgaccacttga

SEQ ID NO: 310 - DNA, 76 bp, Artificial Sequence
  Synthetic sequence-aptamer full sequence
tagggaagagaaggacatatgatggccgatctggatgggggctcgggcgagtcttgactagtacatgaccacttga

SEQ ID NO: 311 - DNA, 76 bp, Artificial Sequence
  Synthetic sequence-aptamer full sequence
tagggaagagaaggacatatgatggcctgcgatggatgaggtgctgcactagtttgactagtacatgaccacttga

SEQ ID NO: 312 - DNA, 76 bp, Artificial Sequence
  Synthetic sequence-aptamer full sequence
tagggaagagaaggacatatgatgtacgcgctctggatgtggttggttagtctttgactagtacatgaccacttga

SEQ ID NO: 313 - DNA, 76 bp, Artificial Sequence
  Synthetic sequence-aptamer full sequence
tagggaagagaaggacatatgatggccgccgatggatgttggcattgctggtcttgactagtacatgaccacttga

SEQ ID NO: 314 - DNA, 76 bp, Artificial Sequence
  Synthetic sequence-aptamer full sequence
tagggaagagaaggacatatgatggccgatctggatggggtatgtgtctaggcttgactagtacatgaccacttga

SEQ ID NO: 315 - DNA, 76 bp, Artificial Sequence
  Synthetic sequence-aptamer full sequence
tagggaagagaaggacatatgatgtccgtcgatggatggggttgggttcagtcttgactagtacatgaccacttga

SEQ ID NO: 316 - DNA, 76 bp, Artificial Sequence
  Synthetic sequence-aptamer full sequence
tagggaagagaaggacatatgatgtgcttggatccctatcaggtggacgtgtattgactagtacatgaccacttga

SEQ ID NO: 317 - DNA, 76 bp, Artificial Sequence
  Synthetic sequence-aptamer full sequence
tagggaagagaaggacatatgatgtcgttcgatggatgtgtgctgtatgagtcttgactagtacatgaccacttga

SEQ ID NO: 318 - DNA, 76 bp, Artificial Sequence
  Synthetic sequence-aptamer full sequence
tagggaagagaaggacatatgatgtccgacgatgggtgggggaatgcgacggcttgactagtacatgaccacttga

SEQ ID NO: 319 - DNA, 76 bp, Artificial Sequence
  Synthetic sequence-aptamer full sequence
tagggaagagaaggacatatgatgtgcgccgatgggtgtgtgtcgtggctggtttgactagtacatgaccacttga

SEQ ID NO: 320 - DNA, 76 bp, Artificial Sequence
  Synthetic sequence-aptamer full sequence
tagggaagagaaggacatatgatgtcctgatctgggtgtgggggtgtgcaggcttgactagtacatgaccacttga

SEQ ID NO: 321 - DNA, 76 bp, Artificial Sequence
  Synthetic sequence-aptamer full sequence
tagggaagagaaggacatatgatggcctgactgggtgtgggtagttacttggcttgactagtacatgaccacttga

SEQ ID NO: 322 - DNA, 76 bp, Artificial Sequence
  Synthetic sequence-aptamer full sequence
tagggaagagaaggacatatgatggacgcatcgccccttcgagtggacaggtattgactagtacatgaccacttga

SEQ ID NO: 323 - DNA, 76 bp, Artificial Sequence
  Synthetic sequence-aptamer full sequence
tagggaagagaaggacatatgatggcctgactgggtgtggttaggaacgcgtcttgactagtacatgaccacttga

SEQ ID NO: 324 - DNA, 76 bp, Artificial Sequence
  Synthetic sequence-aptamer full sequence
tagggaagagaaggacatatgatgtcatgcgatggatgggggctggcagtcgtttgactagtacatgaccacttga

SEQ ID NO: 325 - DNA, 76 bp, Artificial Sequence
  Synthetic sequence-aptamer full sequence
tagggaagagaaggacatatgataatgtggcgggatctggatgtgtgcatgtattgactagtacatgaccacttga

SEQ ID NO: 326 - DNA, 76 bp, Artificial Sequence
  Synthetic sequence-aptamer full sequence
tagggaagagaaggacatatgatggcctggtctggatgggggcgggtataggcttgactagtacatgaccacttga

SEQ ID NO: 327 - DNA, 76 bp, Artificial Sequence
  Synthetic sequence-aptamer full sequence
tagggaagagaaggacatatgatggcctgggatggatgtggtgtattaggctgttgactagtacatgaccacttga

SEQ ID NO: 328 - DNA, 76 bp, Artificial Sequence
  Synthetic sequence-aptamer full sequence
tagggaagagaaggacatatgatgcccgactctggatgggggaatgcgcagtcttgactagtacatgaccacttga

SEQ ID NO: 329 - DNA, 76 bp, Artificial Sequence
  Synthetic sequence-aptamer full sequence
tagggaagagaaggacatatgatgtcgtgctctgggtggggttgtgtagtagtttgactagtacatgaccacttga

SEQ ID NO: 330 - DNA, 76 bp, Artificial Sequence
  Synthetic sequence-aptamer full sequence
tagggaagagaaggacatatgatgtcattcgctggatgtgttgatgtctggtcttgactagtacatgaccacttga

SEQ ID NO: 331 - DNA, 76 bp, Artificial Sequence
  Synthetic sequence-aptamer full sequence
tagggaagagaaggacatatgatggccggcgatggatgtgtatgtggtagtcgttgactagtacatgaccacttga

SEQ ID NO: 332 - DNA, 76 bp, Artificial Sequence
  Synthetic sequence-aptamer full sequence
tagggaagagaaggacatatgatggacgcggctggatgggggcttgcactgtcttgactagtacatgaccacttga

SEQ ID NO: 333 - DNA, 76 bp, Artificial Sequence
  Synthetic sequence-aptamer full sequence
tagggaagagaaggacatatgatggccggcgatggatgtgtgcgtgtattagcttgactagtacatgaccacttga

SEQ ID NO: 334 - DNA, 76 bp, Artificial Sequence
  Synthetic sequence-aptamer full sequence
tagggaagagaaggacatatgatggccgccgatgggtgtggaggtgtacttgtttgactagtacatgaccacttga

SEQ ID NO: 335 - DNA, 76 bp, Artificial Sequence
  Synthetic sequence-aptamer full sequence
tagggaagagaaggacatatgatggcctgcgatggatgtggttgtgcttgtttttgactagtacatgaccacttga

SEQ ID NO: 336 - DNA, 76 bp, Artificial Sequence
  Synthetic sequence-aptamer full sequence
tagggaagagaaggacatatgatggccgacgatggcgtagcgtctgtactgttttgactagtacatgaccacttga

SEQ ID NO: 337 - DNA, 76 bp, Artificial Sequence
  Synthetic sequence-aptamer full sequence
tagggaagagaaggacatatgatggccgtgtctgggtgggggtatgcactgtcttgactagtacatgaccacttga

SEQ ID NO: 338 - DNA, 76 bp, Artificial Sequence
  Synthetic sequence-aptamer full sequence
tagggaagagaaggacatatgatggccggcgatggatgtgaaatggcttgtctttgactagtacatgaccacttga

SEQ ID NO: 339 - DNA, 76 bp, Artificial Sequence
  Synthetic sequence-aptamer full sequence
tagggaagagaaggacatatgatggccgcgtctgggtgttggttgtgttaggcttgactagtacatgaccacttga

SEQ ID NO: 340 - DNA, 76 bp, Artificial Sequence
  Synthetic sequence-aptamer full sequence
tagggaagagaaggacatatgatggacagcgatggatgtggaaatgcgacgtcttgactagtacatgaccacttga

SEQ ID NO: 341 - DNA, 76 bp, Artificial Sequence
  Synthetic sequence-aptamer full sequence
tagggaagagaaggacatatgatggactgcgcgtgacctatcaatggcatgtattgactagtacatgaccacttga

SEQ ID NO: 342 - DNA, 76 bp, Artificial Sequence
  Synthetic sequence-aptamer full sequence
tagggaagagaaggacatatgatggccagctctggatgaggtctgtgcgaggcttgactagtacatgaccacttga

SEQ ID NO: 343 - DNA, 76 bp, Artificial Sequence
  Synthetic sequence-aptamer full sequence
tagggaagagaaggacatatgatgtccgaccgcacccttcgaggggacatggattgactagtacatgaccacttga

SEQ ID NO: 344 - DNA, 76 bp, Artificial Sequence
  Synthetic sequence-aptamer full sequence
tagggaagagaaggacatatgatggccaatgcgccccttcatgttgtcgtgtattgactagtacatgaccacttga

SEQ ID NO: 345 - DNA, 76 bp, Artificial Sequence
  Synthetic sequence-aptamer full sequence
tagggaagagaaggacatatgatggccggctataccctacacgtgatcaggtattgactagtacatgaccacttga

SEQ ID NO: 346 - DNA, 76 bp, Artificial Sequence
  Synthetic sequence-aptamer full sequence
tagggaagagaaggacatatgatgtgcgcacgatggatgtggatggccagtctttgactagtacatgaccacttga

SEQ ID NO: 347 - DNA, 76 bp, Artificial Sequence
  Synthetic sequence-aptamer full sequence
tagggaagagaaggacatatgatggcatgcgatggatgggggctggggcagtcttgactagtacatgaccacttga

SEQ ID NO: 348 - DNA, 76 bp, Artificial Sequence
  Synthetic sequence-aptamer full sequence
tagggaagagaaggacatatgatgtcatgcgctggatgtgggttgttataggcttgactagtacatgaccacttga

SEQ ID NO: 349 - DNA, 76 bp, Artificial Sequence
  ASynthetic sequence-aptamer full sequence
tagggaagagaaggacatatgatgtgcgcctctggatggggtttgtcgacggcttgactagtacatgaccacttga

SEQ ID NO: 350 - DNA, 76 bp, Artificial Sequence
  Synthetic sequence-aptamer full sequence
tagggaagagaaggacatatgatggccagctctggatgtggcattgtctggtcttgactagtacatgaccacttga

SEQ ID NO: 351 - DNA, 76 bp, Artificial Sequence
  ASynthetic sequence-aptamer full sequence
tagggaagagaaggacatatgatggcctgagctggcattgcgctggacatgtattgactagtacatgaccacttga

SEQ ID NO: 352 - DNA, 76 bp, Artificial Sequence
  Synthetic sequence-aptamer full sequence
tagggaagagaaggacatatgatggccgccgatgggtgtgggatcgtgcgggcttgactagtacatgaccacttga

SEQ ID NO: 353 - DNA, 76 bp, Artificial Sequence
  Synthetic sequence-aptamer full sequence
tagggaagagaaggacatatgatggccgacgctgggtgggggcgttgactagtttgactagtacatgaccacttga

SEQ ID NO: 354 - DNA, 76 bp, Artificial Sequence
  Synthetic sequence-aptamer full sequence
tagggaagagaaggacatatgatggactacgctggatggggacattgctagttttgactagtacatgaccacttga

SEQ ID NO: 355 - DNA, 76 bp, Artificial Sequence
  Synthetic sequence-aptamer full sequence
tagggaagagaaggacatatgatggcatgcgatgggtgtgttctggcgacggcttgactagtacatgaccacttga

SEQ ID NO: 356 - DNA, 76 bp, Artificial Sequence
  Synthetic sequence-aptamer full sequence
tagggaagagaaggacatatgatggactacgctggatgtgggttggggtagtcttgactagtacatgaccacttga

SEQ ID NO: 357 - DNA, 76 bp, Artificial Sequence
  Synthetic sequence-aptamer full sequence
tagggaagagaaggacatatgatggccgagcttacctgtcaagtgcgagtgtattgactagtacatgaccacttga

SEQ ID NO: 358 - DNA, 76 bp, Artificial Sequence
  Synthetic sequence-aptamer full sequence
tagggaagagaaggacatatgatgtgcttcgatggatgtgggcgttgcaagtcttgactagtacatgaccacttga

SEQ ID NO: 359 - DNA, 76 bp, Artificial Sequence
  Synthetic sequence-aptamer full sequence
tagggaagagaaggacatatgatgtccgcggctgggtgtgggaagtactcggcttgactagtacatgaccacttga

SEQ ID NO: 360 - DNA, 76 bp, Artificial Sequence
  Synthetic sequence-aptamer full sequence
tagggaagagaaggacatatgatgtccgcgcgatggatgaggacgtgagctagttgactagtacatgaccacttga

SEQ ID NO: 361 - DNA, 76 bp, Artificial Sequence
  Synthetic sequence-aptamer full sequence
tagggaagagaaggacatatgatggccgagtcgtcacttcaattgggcgtggattgactagtacatgaccacttga

SEQ ID NO: 362 - DNA, 76 bp, Artificial Sequence
  Synthetic sequence-aptamer full sequence
tagggaagagaaggacatatgatgtcggtcggagggatggtctcgttgacggcttgactagtacatgaccacttga

SEQ ID NO: 363 - DNA, 76 bp, Artificial Sequence
  Synthetic sequence-aptamer full sequence
tagggaagagaaggacatatgatggccacacgctgccctaaagtgttcgtgtattgactagtacatgaccacttga

SEQ ID NO: 364 - DNA, 76 bp, Artificial Sequence
  Synthetic sequence-aptamer full sequence
tagggaagagaaggacatatgatggcctgcgatggatgtgtgcgtgtattagtttgactagtacatgaccacttga

SEQ ID NO: 365 - DNA, 76 bp, Artificial Sequence
  Synthetic sequence-aptamer full sequence
tagggaagagaaggacatatgatgtgcgctgtcttgcctacaagtgtcgtgtattgactagtacatgaccacttga

SEQ ID NO: 366 - DNA, 76 bp, Artificial Sequence
  Synthetic sequence-aptamer full sequence
tagggaagagaaggacatatgatggccgaactggatgggggcattactgcggcttgactagtacatgaccacttga

SEQ ID NO: 367 - DNA, 76 bp, Artificial Sequence
  Synthetic sequence-aptamer full sequence
tagggaagagaaggacatatgatggccgagctggatggggtattggatctagtttgactagtacatgaccacttga

SEQ ID NO: 368 - DNA, 76 bp, Artificial Sequence
  Synthetic sequence-aptamer full sequence
tagggaagagaaggacatatgattggccgcactctgggtgtggtggacttggcttgactagtacatgaccacttga

SEQ ID NO: 369 - DNA, 76 bp, Artificial Sequence
  Synthetic sequence-aptamer full sequence
tagggaagagaaggacatatgatggccggtctggatgggggcgtacgtcgtcgttgactagtacatgaccacttga

SEQ ID NO: 370 - DNA, 76 bp, Artificial Sequence
  Synthetic sequence-aptamer full sequence
tagggaagagaaggacatatgatggcctgctatgggtgggggctcgtactggcttgactagtacatgaccacttga

SEQ ID NO: 371 - DNA, 76 bp, Artificial Sequence
  Synthetic sequence-aptamer full sequence
tagggaagagaaggacatatgatgtacgcccgatggatgtggattgtactgttttgactagtacatgaccacttga

SEQ ID NO: 372 - DNA, 76 bp, Artificial Sequence
  Synthetic sequence-aptamer full sequence
tagggaagagaaggacatatgatggcctgcgatggatgtgggccagtacgcgcttgactagtacatgaccacttga

SEQ ID NO: 373 - DNA, 76 bp, Artificial Sequence
  Synthetic sequence-aptamer full sequence
tagggaagagaaggacatatgatgacctgcgatgggtgtggctctgtcagtctttgactagtacatgaccacttga

SEQ ID NO: 374 - DNA, 76 bp, Artificial Sequence
  Synthetic sequence-aptamer full sequence
tagggaagagaaggacatatgatgtccgaactggatgtggtattggcctgtctttgactagtacatgaccacttga

SEQ ID NO: 375 - DNA, 76 bp, Artificial Sequence
  Synthetic sequence-aptamer full sequence
tagggaagagaaggacatatgatgttcttgtctggatggggttgatgtcggtcttgactagtacatgaccacttga

SEQ ID NO: 376 - DNA, 76 bp, Artificial Sequence
  Synthetic sequence-aptamer full sequence
tagggaagagaaggacatatgatgtactcgatgggtgtgggtaggcgcgagtcttgactagtacatgaccacttga

SEQ ID NO: 377 - DNA, 76 bp, Artificial Sequence
  Synthetic sequence-aptamer full sequence
tagggaagagaaggacatatgatgtcctcgatgggtgtgagatatgtgctagcttgactagtacatgaccacttga

SEQ ID NO: 378 - DNA, 76 bp, Artificial Sequence
  Synthetic sequence-aptamer full sequence
tagggaagagaaggacatatgatggccgtgctctgggtgtgggcctgctgggcttgactagtacatgaccacttga

SEQ ID NO: 379 - DNA, 76 bp, Artificial Sequence
  Synthetic sequence-aptamer full sequence
tagggaagagaaggacatatgatgttcgtatctgggtgtggtgtgtctgggctttgactagtacatgaccacttga

SEQ ID NO: 380 - DNA, 76 bp, Artificial Sequence
  Synthetic sequence-aptamer full sequence
tagggaagagaaggacatatgatggccgagtctggatgtgtgtcgtacgtatcttgactagtacatgaccacttga

SEQ ID NO: 381 - DNA, 76 bp, Artificial Sequence
  Synthetic sequence-aptamer full sequence
tagggaagagaaggacatatgatggcgttcactgggtgtggatgtgtgcggtcttgactagtacatgaccacttga

SEQ ID NO: 382 - DNA, 76 bp, Artificial Sequence
  Synthetic sequence-aptamer full sequence
tagggaagagaaggacatatgatgtcatgcgctgggtgtggcctgttgtaggcttgactagtacatgaccacttga

SEQ ID NO: 383 - DNA, 76 bp, Artificial Sequence
  Synthetic sequence-aptamer full sequence
tagggaagagaaggacatatgatgctccgtacgatggctgtgctggtgatgtattgactagtacatgaccacttga

SEQ ID NO: 384 - DNA, 76 bp, Artificial Sequence
  Synthetic sequence-aptamer full sequence
tagggaagagaaggacatatgatggactgcgatgggtggggttatgtgccagcttgactagtacatgaccacttga

SEQ ID NO: 385 - DNA, 76 bp, Artificial Sequence
  Synthetic sequence-aptamer full sequence
tagggaagagaaggacatatgatgtgcgatcgtacctatcaatggtcatcgtattgactagtacatgaccacttga

SEQ ID NO: 386 - DNA, 76 bp, Artificial Sequence
  Synthetic sequence-aptamer full sequence
tagggaagagaaggacatatgatgttcgtcgaatggatgtgagcatgtctgtcttgactagtacatgaccacttga

SEQ ID NO: 387 - DNA, 76 bp, Artificial Sequence
  Synthetic sequence-aptamer full sequence
tagggaagagaaggacatatgatggccgtacgatggatgtgggatggtctagcttgactagtacatgaccacttga

SEQ ID NO: 388 - DNA, 76 bp, Artificial Sequence
  Synthetic sequence-aptamer full sequence
tagggaagagaaggacatatgatgtcattaactggatgtgggactgtcggtctttgactagtacatgaccacttga

SEQ ID NO: 389 - DNA, 76 bp, Artificial Sequence
  Synthetic sequence-aptamer full sequence
tagggaagagaaggacatatgatggacgatctgggtgtggacagggatgaggcttgactagtacatgaccacttga

SEQ ID NO: 390 - DNA, 76 bp, Artificial Sequence
  Synthetic sequence-aptamer full sequence
tagggaagagaaggacatatgatggcatgcgatggatgtggtgtacccagtccttgactagtacatgaccacttga

SEQ ID NO: 391 - DNA, 76 bp, Artificial Sequence
  Synthetic sequence-aptamer full sequence
tagggaagagaaggacatatgatggccgcgatggatgtggaaaggtctagtcattgactagtacatgaccacttga

SEQ ID NO: 392 - DNA, 76 bp, Artificial Sequence
  Synthetic sequence-aptamer full sequence
tagggaagagaaggacatatgatggccgacctggatgtgagcatgcatctagtttgactagtacatgaccacttga

SEQ ID NO: 393 - DNA, 76 bp, Artificial Sequence
  Synthetic sequence-aptamer full sequence
tagggaagagaaggacatatgatgtacgagcggaccgatcaagtgcgtctgtattgactagtacatgaccacttga

SEQ ID NO: 394 - DNA, 76 bp, Artificial Sequence
  Synthetic sequence-aptamer full sequence
tagggaagagaaggacatatgatgtactgcactgccctacacgtgggaatggattgactagtacatgaccacttga

SEQ ID NO: 395 - DNA, 76 bp, Artificial Sequence
  Synthetic sequence-aptamer full sequence
tagggaagagaaggacatatgatgtcattcgatggatgtggcgtgtgcgtcatttgactagtacatgaccacttga

SEQ ID NO: 396 - DNA, 76 bp, Artificial Sequence
  Synthetic sequence-aptamer full sequence
tagggaagagaaggacatatgatggcgtacgatggatgtgcgttgtgtctgtcttgactagtacatgaccacttga

SEQ ID NO: 397 - DNA, 76 bp, Artificial Sequence; identical to SEQ ID NO: 297
  Synthetic sequence-aptamer full sequence

SEQ ID NO: 398 - DNA, 76 bp, Artificial Sequence
  Synthetic sequence-aptamer full sequence
tagggaagagaaggacatatgatgtcattccgcatcctacacgtgggcacgtattgactagtacatgaccacttga

SEQ ID NO: 399 - DNA, 76 bp, Artificial Sequence; identical to SEQ ID NO: 344
  Synthetic sequence-aptamer full sequence

SEQ ID NO: 400 - DNA, 76 bp, Artificial Sequence; identical to SEQ ID NO: 311
  Synthetic sequence-aptamer full sequence

SEQ ID NO: 401 - DNA, 76 bp, Artificial Sequence; identical to SEQ ID NO: 307
  Synthetic sequence-aptamer full sequence

SEQ ID NO: 402 - DNA, 76 bp, Artificial Sequence
  Synthetic sequence-aptamer full sequence
tagggaagagaaggacatatgatgtcgtgactggctagctggacatgcactgcttgactagtacatgaccacttga

SEQ ID NO: 403 - DNA, 76 bp, Artificial Sequence; identical to SEQ ID NO: 303
  Synthetic sequence-aptamer full sequence

SEQ ID NO: 404 - DNA, 76 bp, Artificial Sequence
  Synthetic sequence-aptamer full sequence
tagggaagagaaggacatatgatgtgcatcgatggcgtatgctggtgatgtgcttgactagtacatgaccacttga

SEQ ID NO: 405 - DNA, 76 bp, Artificial Sequence
  Synthetic sequence-aptamer full sequence
tagggaagagaaggacatatgatgcgacagcgacatacgatctgctctgcgtcttgactagtacatgaccacttga

SEQ ID NO: 406 - DNA, 76 bp, Artificial Sequence
  Synthetic sequence-aptamer full sequence
tagggaagagaaggacatatgatgtcatgccatcccttcgagtgtgacaggtattgactagtacatgaccacttga

SEQ ID NO: 407 - DNA, 76 bp, Artificial Sequence; identical to SEQ ID NO: 323
  Synthetic sequence-aptamer full sequence

SEQ ID NO: 408 - DNA, 76 bp, Artificial Sequence; identical to SEQ ID NO: 346
  Synthetic sequence-aptamer full sequence

SEQ ID NO: 409 - DNA, 76 bp, Artificial Sequence; identical to SEQ ID NO: 319
  Synthetic sequence-aptamer full sequence

SEQ ID NO: 410 - DNA, 76 bp, Artificial Sequence; identical to SEQ ID NO: 390
  Synthetic sequence-aptamer full sequence

SEQ ID NO: 411 - DNA, 76 bp, Artificial Sequence
  ASynthetic sequence-aptamer full sequence
tagggaagagaaggacatatgatccatatggcagtgcgatggcttcgctggtcttgactagtacatgaccacttga

SEQ ID NO: 412 - DNA, 76 bp, Artificial Sequence; identical to SEQ ID NO: 383
  Synthetic sequence-aptamer full sequence

SEQ ID NO: 413 - DNA, 76 bp, Artificial Sequence; identical to SEQ ID NO: 300
  Synthetic sequence-aptamer full sequence

SEQ ID NO: 414 - DNA, 76 bp, Artificial Sequence; identical to SEQ ID NO: 304
  Synthetic sequence-aptamer full sequence

SEQ ID NO: 415 - DNA, 76 bp, Artificial Sequence; identical to SEQ ID NO: 394
  Synthetic sequence-aptamer full sequence

SEQ ID NO: 416 - DNA, 76 bp, Artificial Sequence
  Synthetic sequence-aptamer full sequence
tagggaagagaaggacatatgatcgcaccgtcgatacgtcatgcacgctgacattgactagtacatgaccacttga

SEQ ID NO: 417 - DNA, 76 bp, Artificial Sequence
  Synthetic sequence-aptamer full sequence
tagggaagagaaggacatatgatgtacgcacgatgagcgccaagtgacatggattgactagtacatgaccacttga

SEQ ID NO: 418 - DNA, 76 bp, Artificial Sequence; identical to SEQ ID NO: 362
  Synthetic sequence-aptamer full sequence

SEQ ID NO: 419 - DNA, 76 bp, Artificial Sequence
  Synthetic sequence-aptamer full sequence
tagggaagagaaggacatatgatggcatgcgatgaacgaggcatgatgcgtcattgactagtacatgaccacttga

SEQ ID NO: 420 - DNA, 76 bp, Artificial Sequence; identical to SEQ ID NO: 396
  Synthetic sequence-aptamer full sequence

SEQ ID NO: 421 - DNA, 76 bp, Artificial Sequence
  Synthetic sequence-aptamer full sequence
tagggaagagaaggacatatgatgtcactgtgcctgaccgtcaagttgcggcattgactagtacatgaccacttga

SEQ ID NO: 422 - DNA, 76 bp, Artificial Sequence; identical to SEQ ID NO: 341
  Synthetic sequence-aptamer full sequence

SEQ ID NO: 423 - DNA, 76 bp, Artificial Sequence; identical to SEQ ID NO: 351
  Synthetic sequence-aptamer full sequence

SEQ ID NO: 424 - DNA, 76 bp, Artificial Sequence
  Synthetic sequence-aptamer full sequence
tagggaagagaaggacatatgatgcattggacgatcgtgccctacacgtgggcttgactagtacatgaccacttga

SEQ ID NO: 425 - DNA, 76 bp, Artificial Sequence; identical to SEQ ID NO: 322
  Synthetic sequence-aptamer full sequence

SEQ ID NO: 426 - DNA, 76 bp, Artificial Sequence; identical to SEQ ID NO: 363
  Synthetic sequence-aptamer full sequence

SEQ ID NO: 427 - DNA, 76 bp, Artificial Sequence
  Synthetic sequence-aptamer full sequence
tagggaagagaaggacatatgatgttctgactgggtgtggtgctgcactgtcattgactagtacatgaccacttga

SEQ ID NO: 428 - DNA, 76 bp, Artificial Sequence
  Synthetic sequence-aptamer full sequence
tagggaagagaaggacatatgatggcaacgcacatcgtatcacgcatcggaccttgactagtacatgaccacttga

SEQ ID NO: 429 - DNA, 76 bp, Artificial Sequence
  Synthetic sequence-aptamer full sequence
tagggaagagaaggacatatgatgtcatgcgcggacattcaagttggcgtggattgactagtacatgaccacttga

SEQ ID NO: 430 - DNA, 76 bp, Artificial Sequence
  Synthetic sequence-aptamer full sequence
tagggaagagaaggacatatgatccgtagcgacatcaagcggtggtgtgcgtgttgactagtacatgaccacttga

SEQ ID NO: 431 - DNA, 76 bp, Artificial Sequence; identical to SEQ ID NO: 308
  Synthetic sequence-aptamer full sequence

SEQ ID NO: 432 - DNA, 76 bp, Artificial Sequence
  Synthetic sequence-aptamer full sequence
tagggaagagaaggacatatgatgacctgactgtgcctatcgagtgcgtgatgttgactagtacatgaccacttga

SEQ ID NO: 433 - DNA, 76 bp, Artificial Sequence
  Synthetic sequence-aptamer full sequence
tagggaagagaaggacatatgattggccgatcgaccctatcaagtgcagcatgttgactagtacatgaccacttga

SEQ ID NO: 434 - DNA, 76 bp, Artificial Sequence
  Synthetic sequence-aptamer full sequence
tagggaagagaaggacatatgatgttccgagctggatgtggcctgtgctatgcttgactagtacatgaccacttga

SEQ ID NO: 435 - DNA, 76 bp, Artificial Sequence
  Synthetic sequence-aptamer full sequence
tagggaagagaaggacatatgatggcatgcgatggatgtgtgcgtgtattagcttgactagtacatgaccacttga

SEQ ID NO: 436 - DNA, 76 bp, Artificial Sequence
  Synthetic sequence-aptamer full sequence
tagggaagagaaggacatatgatgtacgcatcgtcccgtcatgtggttccgtattgactagtacatgaccacttga

SEQ ID NO: 437 - DNA, 76 bp, Artificial Sequence
  Synthetic sequence-aptamer full sequence
tagggaagagaaggacatatgatggcattgcgcgcctagcaagttgacgtgtattgactagtacatgaccacttga

SEQ ID NO: 438 - DNA, 76 bp, Artificial Sequence
  Synthetic sequence-aptamer full sequence
tagggaagagaaggacatatgatggacgcacgcagaccttcaagtcggccatgttgactagtacatgaccacttga

SEQ ID NO: 439 - DNA, 76 bp, Artificial Sequence
  Synthetic sequence-aptamer full sequence
tagggaagagaaggacatatgatgtgctgcatgagcggtgtgcgtgtacgacgttgactagtacatgaccacttga

SEQ ID NO: 440 - DNA, 76 bp, Artificial Sequence
  Synthetic sequence-aptamer full sequence
tagggaagagaaggacatatgatgtcatgctcgcactatcaggtgtgcatggattgactagtacatgaccacttga

SEQ ID NO: 441 - DNA, 76 bp, Artificial Sequence
  Synthetic sequence-aptamer full sequence
tagggaagagaaggacatatgatgtgcgcggcttgccttcacgtgatcgtgtattgactagtacatgaccacttga

SEQ ID NO: 442 - DNA, 76 bp, Artificial Sequence
  Synthetic sequence-aptamer full sequence
tagggaagagaaggacatatgatgtcatacgatgggtgtggtatgtgtacgtattgactagtacatgaccacttga

SEQ ID NO: 443 - DNA, 76 bp, Artificial Sequence
  Synthetic sequence-aptamer full sequence
tagggaagagaaggacatatgatgcatgcgttggacttgtctggctgtgggtgttgactagtacatgaccacttga

SEQ ID NO: 444 - DNA, 76 bp, Artificial Sequence
  Synthetic sequence-aptamer full sequence
tagggaagagaaggacatatgattgcgtcgtatgtgcggctcggatgtgtgtcttgactagtacatgaccacttga

SEQ ID NO: 445 - DNA, 76 bp, Artificial Sequence
  Synthetic sequence-aptamer full sequence
tagggaagagaaggacatatgatggacgcagcttgcctactggtggtcacgtattgactagtacatgaccacttga

SEQ ID NO: 446 - DNA, 76 bp, Artificial Sequence
  Synthetic sequence-aptamer full sequence
tagggaagagaaggacatatgatggccatcgatgggtgtggctgtacttgacattgactagtacatgaccacttga

SEQ ID NO: 447 - DNA, 76 bp, Artificial Sequence
  Synthetic sequence-aptamer full sequence
tagggaagagaaggacatatgatgcgtgtcagcaatacgtcctcatctgcccgttgactagtacatgaccacttga

SEQ ID NO: 448 - DNA, 76 bp, Artificial Sequence; identical to SEQ ID NO: 385
  Synthetic sequence-aptamer full sequence

SEQ ID NO: 449 - DNA, 76 bp, Artificial Sequence; identical to SEQ ID NO: 347
  Synthetic sequence-aptamer full sequence

SEQ ID NO: 450 - DNA, 76 bp, Artificial Sequence; identical to SEQ ID NO: 336
  Synthetic sequence-aptamer full sequence

SEQ ID NO: 451 - DNA, 76 bp, Artificial Sequence
  Synthetic sequence-aptamer full sequence
tagggaagagaaggacatatgattggccgatcatccctcaagttggcgtgtgcttgactagtacatgaccacttga

SEQ ID NO: 452 - DNA, 76 bp, Artificial Sequence; identical to SEQ ID NO: 387
  Synthetic sequence-aptamer full sequence

SEQ ID NO: 453 - DNA, 76 bp, Artificial Sequence
  Synthetic sequence-aptamer full sequence
tagggaagagaaggacatatgatggcacaaacggaccgacaagtgcgcatggattgactagtacatgaccacttga

SEQ ID NO: 454 - DNA, 76 bp, Artificial Sequence
  Synthetic sequence-aptamer full sequence
tagggaagagaaggacatatgatgtacggaacggaacaacaagggcaggcatgttgactagtacatgaccacttga

SEQ ID NO: 455 - DNA, 76 bp, Artificial Sequence
  Synthetic sequence-aptamer full sequence
tagggaagagaaggacatatgatggacgcacatcccgttcatgtgtgcatgtattgactagtacatgaccacttga

SEQ ID NO: 456 - DNA, 76 bp, Artificial Sequence
  Synthetic sequence-aptamer full sequence
tagggaagagaaggacatatgatggccaagctggatgtgttcaggtcacgacgttgactagtacatgaccacttga

SEQ ID NO: 457 - DNA, 71 bp, Artificial Sequence
  Synthetic sequence-aptamer full sequence
tagggaagagaaggacatatgatggcctgcgatggatgtgtgcgtgtattgactagtacatgaccacttga

SEQ ID NO: 458 - DNA, 76 bp, Artificial Sequence
  Synthetic sequence-aptamer full sequence
tagggaagagaaggacatatgatcgtgcgcgagacatggtccatcggttcgtgttgactagtacatgaccacttga

SEQ ID NO: 459 - DNA, 76 bp, Artificial Sequence; identical to SEQ ID NO: 382
  Synthetic sequence-aptamer full sequence

SEQ ID NO: 460 - DNA, 76 bp, Artificial Sequence
  Synthetic sequence-aptamer full sequence
tagggaagagaaggacatatgatgtcgcgatgagctagcatgtgcgttgtgtattgactagtacatgaccacttga

SEQ ID NO: 461 - DNA, 76 bp, Artificial Sequence
  Synthetic sequence-aptamer full sequence
tagggaagagaaggacatatgatgtgctacgatggctgtgggcgtgatgcgtattgactagtacatgaccacttga

SEQ ID NO: 462 - DNA, 76 bp, Artificial Sequence
  Synthetic sequence-aptamer full sequence
tagggaagagaaggacatatgatgacgctgcgttccctatcatgtgcggcatgttgactagtacatgaccacttga

SEQ ID NO: 463 - DNA, 76 bp, Artificial Sequence
  Synthetic sequence-aptamer full sequence
tagggaagagaaggacatatgatgttcgcgcgacacctatcaatgtggacgtgttgactagtacatgaccacttga

SEQ ID NO: 464 - DNA, 76 bp, Artificial Sequence
  Synthetic sequence-aptamer full sequence
tagggaagagaaggacatatgatgcacgactcgcaccctatcatgaggccatgttgactagtacatgaccacttga

SEQ ID NO: 465 - DNA, 76 bp, Artificial Sequence
  Synthetic sequence-aptamer full sequence
tagggaagagaaggacatatgatgtcatgaaacgagcctacacgtggtgcatgttgactagtacatgaccacttga

SEQ ID NO: 466 - DNA, 76 bp, Artificial Sequence
  Synthetic sequence-aptamer full sequence
tagggaagagaaggacatatgatggacgcgatgggcgtgggtatgcacttggcttgactagtacatgaccacttga

SEQ ID NO: 467 - DNA, 77 bp, Artificial Sequence
  Synthetic sequence-aptamer full sequence
tagggaagagaaggacatatgatgtactgcgatggcttagcaaagtgcgacatgttgactagtacatgaccacttga

SEQ ID NO: 468 - DNA, 76 bp, Artificial Sequence
  Synthetic sequence-aptamer full sequence
tagggaagagaaggacatatgattgccctggcaatgcgatgttcgatgcgaccttgactagtacatgaccacttga

SEQ ID NO: 469 - DNA, 76 bp, Artificial Sequence
  Synthetic sequence-aptamer full sequence
tagggaagagaaggacatatgatgtacgcgacgtccctgagagtgtgcaggtattgactagtacatgaccacttga

SEQ ID NO: 470 - DNA, 76 bp, Artificial Sequence
  Synthetic sequence-aptamer full sequence
tagggaagagaaggacatatgatgtgcgccgatatcccttcacagttggcatgttgactagtacatgaccacttga

SEQ ID NO: 471 - DNA, 76 bp, Artificial Sequence
  Synthetic sequence-aptamer full sequence
tagggaagagaaggacatatgatggccgacgatggatgggaggcatgactggcttgactagtacatgaccacttga

SEQ ID NO: 472 - DNA, 76 bp, Artificial Sequence
  Synthetic sequence-aptamer full sequence
tagggaagagaaggacatatgatgtacgcgctggtcccgtatcatgtgcgtcattgactagtacatgaccacttga

SEQ ID NO: 473 - DNA, 74 bp, Artificial Sequence
  Synthetic sequence-aptamer full sequence
tagggaagagaaggacatatgatggcctcgatggatgtggtggtgctgtcattgactagtacatgaccacttga

SEQ ID NO: 474 - DNA, 76 bp, Artificial Sequence; identical to SEQ ID NO: 366
  Synthetic sequence-aptamer full sequence

SEQ ID NO: 475 - DNA, 76 bp, Artificial Sequence
  Synthetic sequence-aptamer full sequence
tagggaagagaaggacatatgatgtcacggaacgaagcctatcaagtgcgacattgactagtacatgaccacttga

SEQ ID NO: 476 - DNA, 76 bp, Artificial Sequence
  Synthetic sequence-aptamer full sequence
tagggaagagaaggacatatgatggcacggaggatggacgttctgccttggtcttgactagtacatgaccacttga

SEQ ID NO: 477 - DNA, 76 bp, Artificial Sequence
  Synthetic sequence-aptamer full sequence
tagggaagagaaggacatatgatgcaactgcacgcattggaccgcacgtcacattgactagtacatgaccacttga

SEQ ID NO: 478 - DNA, 76 bp, Artificial Sequence
  Synthetic sequence-aptamer full sequence
tagggaagagaaggacatatgatgtgctgagctgggagtggtggtgctttggcttgactagtacatgaccacttga

SEQ ID NO: 479 - DNA, 76 bp, Artificial Sequence
  Synthetic sequence-aptamer full sequence
tagggaagagaaggacatatgatgtctgccgatggatgtggtgtacgcagacgttgactagtacatgaccacttga

SEQ ID NO: 480 - DNA, 76 bp, Artificial Sequence
  Synthetic sequence-aptamer full sequence
tagggaagagaaggacatatgatgtacacgatgcaccttcaagttgtgatgtattgactagtacatgaccacttga

SEQ ID NO: 481 - DNA, 76 bp, Artificial Sequence
  Synthetic sequence-aptamer full sequence
tagggaagagaaggacatatgatggacgcgtcgaccttcaagtgtgccgtggattgactagtacatgaccacttga

SEQ ID NO: 482 - DNA, 76 bp, Artificial Sequence; identical to SEQ ID NO: 330
  Synthetic sequence-aptamer full sequence

SEQ ID NO: 483 - DNA, 76 bp, Artificial Sequence
  Synthetic sequence-aptamer full sequence
tagggaagagaaggacatatgatcgcatgggacgtactgaccggatcgtgtcattgactagtacatgaccacttga

SEQ ID NO: 484 - DNA, 76 bp, Artificial Sequence
  Synthetic sequence-aptamer full sequence
tagggaagagaaggacatatgatggccacgatggatgaggacatgactggttgttgactagtacatgaccacttga

SEQ ID NO: 485 - DNA, 76 bp, Artificial Sequence
  Synthetic sequence-aptamer full sequence
tagggaagagaaggacatatgatgtgcgacacgtgttcccgttcaagttgggcttgactagtacatgaccacttga

SEQ ID NO: 486 - DNA, 76 bp, Artificial Sequence
  Synthetic sequence-aptamer full sequence
tagggaagagaaggacatatgatcacgacagcgttagcaggccatgcgacacgttgactagtacatgaccacttga

SEQ ID NO: 487 - DNA, 76 bp, Artificial Sequence
  Synthetic sequence-aptamer full sequence
tagggaagagaaggacatatgatgtcgtgcgtgccctatcaagtcggtctgtattgactagtacatgaccacttga

SEQ ID NO: 488 - DNA, 76 bp, Artificial Sequence; identical to SEQ ID NO: 355
  Synthetic sequence-aptamer full sequence

SEQ ID NO: 489 - DNA, 76 bp, Artificial Sequence
  Synthetic sequence-aptamer full sequence
tagggaagagaaggacatatgatgtctgagcgcaacctcgtggactgtgcgtgttgactagtacatgaccacttga

SEQ ID NO: 490 - DNA, 76 bp, Artificial Sequence; identical to SEQ ID NO: 301
  Synthetic sequence-aptamer full sequence

SEQ ID NO: 491 - DNA, 75 bp, Artificial Sequence
  Synthetic sequence-aptamer full sequence
tagggaagagaaggacatatgatccgtgttgcgtgtccagtctcgttgcgcgttgactagtacatgaccacttga

SEQ ID NO: 492 - DNA, 76 bp, Artificial Sequence; identical to SEQ ID NO: 299
  Synthetic sequence-aptamer full sequence

SEQ ID NO: 493 - DNA, 75 bp, Artificial Sequence
  Synthetic sequence-aptamer full sequence
tagggaagagaaggacatatgatgtgcgatacatcccaacctcccgtgtggcttgactagtacatgaccacttga

SEQ ID NO: 494 - DNA, 76 bp, Artificial Sequence
  Synthetic sequence-aptamer full sequence
tagggaagagaaggacatatgatgccgcaacgactgaggggtgtatgtacgcgttgactagtacatgaccacttga

SEQ ID NO: 495 - DNA, 76 bp, Artificial Sequence
  Synthetic sequence-aptamer full sequence
tagggaagagaaggacatatgatggacgcggatgagcttcgagtgacgtgtacttgactagtacatgaccacttga

SEQ ID NO: 496 - DNA, 76 bp, Artificial Sequence
  Synthetic sequence-aptamer full sequence
tagggaagagaaggacatatgatgtcgtgactggcgtagctggtagtgctaggttgactagtacatgaccacttga

SEQ ID NO: 497 - DNA, 30 bp, Artificial Sequence; identical to SEQ ID NO: 198
  Synthetic sequence-aptamer unique sequence

SEQ ID NO: 498 - DNA, 30 bp, Artificial Sequence
  Synthetic sequence-aptamer unique sequence
ggcatgcacgcacctacacgtgggtatgga

SEQ ID NO: 499 - DNA, 30 bp, Artificial Sequence; identical to SEQ ID NO: 97
  Synthetic sequence-aptamer unique sequence

SEQ ID NO: 500 - DNA, 30 bp, Artificial Sequence; identical to SEQ ID NO: 264
  Synthetic sequence-aptamer unique sequence

SEQ ID NO: 501 - DNA, 30 bp, Artificial Sequence; identical to SEQ ID NO: 206
  Synthetic sequence-aptamer unique sequence

SEQ ID NO: 502 - DNA, 30 bp, Artificial Sequence; identical to SEQ ID NO: 111
  Synthetic sequence-aptamer unique sequence

SEQ ID NO: 503 - DNA, 30 bp, Artificial Sequence; identical to SEQ ID NO: 245
  Synthetic sequence-aptamer unique sequence

SEQ ID NO: 504 - DNA, 30 bp, Artificial Sequence; identical to SEQ ID NO: 144
  Synthetic sequence-aptamer unique sequence

SEQ ID NO: 505 - DNA, 30 bp, Artificial Sequence; identical to SEQ ID NO: 146
  Synthetic sequence-aptamer unique sequence

SEQ ID NO: 506 - DNA, 30 bp, Artificial Sequence; identical to SEQ ID NO: 229
  Synthetic sequence-aptamer unique sequence

SEQ ID NO: 507 - DNA, 30 bp, Artificial Sequence
  Synthetic sequence-aptamer unique sequence
ccgcacgtagccctatcagtggtgcatgca

SEQ ID NO: 508 - DNA, 30 bp, Artificial Sequence
  Synthetic sequence-aptamer unique sequence
ggcatgcgctgggtagtgatcacgtacggt

SEQ ID NO: 509 - DNA, 30 bp, Artificial Sequence; identical to SEQ ID NO: 103
  Synthetic sequence-aptamer unique sequence

SEQ ID NO: 510 - DNA, 30 bp, Artificial Sequence; identical to SEQ ID NO: 100
  Synthetic sequence-aptamer unique sequence

SEQ ID NO: 511 - DNA, 30 bp, Artificial Sequence; identical to SEQ ID NO: 194
  Synthetic sequence-aptamer unique sequence

SEQ ID NO: 512 - DNA, 30 bp, Artificial Sequence; identical to SEQ ID NO: 192
  Synthetic sequence-aptamer unique sequence

SEQ ID NO: 513 - DNA, 30 bp, Artificial Sequence; identical to SEQ ID NO: 216
  Synthetic sequence-aptamer unique sequence

SEQ ID NO: 514 - DNA, 30 bp, Artificial Sequence; identical to SEQ ID NO: 147
  Synthetic sequence-aptamer unique sequence

SEQ ID NO: 515 - DNA, 30 bp, Artificial Sequence
  Synthetic sequence-aptamer unique sequence
gacggtgcgtcctaaagtgctcagtgcgtg

SEQ ID NO: 516 - DNA, 30 bp, Artificial Sequence; identical to SEQ ID NO: 236
  Synthetic sequence-aptamer unique sequence

SEQ ID NO: 517 - DNA, 30 bp, Artificial Sequence
  Synthetic sequence-aptamer unique sequence
gtgcgacctgacctagcaagcggtagtgta

SEQ ID NO: 518 - DNA, 30 bp, Artificial Sequence; identical to SEQ ID NO: 108
  Synthetic sequence-aptamer unique sequence

SEQ ID NO: 519 - DNA, 30 bp, Artificial Sequence
  Synthetic sequence-aptamer unique sequence
ggccaagctgaccgtaaaggcaggcgtgta

SEQ ID NO: 520 - DNA, 30 bp, Artificial Sequence; identical to SEQ ID NO: 269
  Synthetic sequence-aptamer unique sequence

SEQ ID NO: 521 - DNA, 30 bp, Artificial Sequence; identical to SEQ ID NO: 107
  Synthetic sequence-aptamer unique sequence

SEQ ID NO: 522 - DNA, 30 bp, Artificial Sequence
  Synthetic sequence-aptamer unique sequence
cgcaccgtcaagcgggaaggcactttggtg

SEQ ID NO: 523 - DNA, 30 bp, Artificial Sequence; identical to SEQ ID NO: 238
  Synthetic sequence-aptamer unique sequence

SEQ ID NO: 524 - DNA, 30 bp, Artificial Sequence; identical to SEQ ID NO: 230
  Synthetic sequence-aptamer unique sequence

SEQ ID NO: 525 - DNA, 30 bp, Artificial Sequence; identical to SEQ ID NO: 241
  Synthetic sequence-aptamer unique sequence

SEQ ID NO: 526 - DNA, 30 bp, Artificial Sequence
  Synthetic sequence-aptamer unique sequence
ggcctgatcgaacctagagagtggcgtgga

SEQ ID NO: 527 - DNA, 30 bp, Artificial Sequence; identical to SEQ ID NO: 122
  Synthetic sequence-aptamer unique sequence

SEQ ID NO: 528 - DNA, 30 bp, Artificial Sequence; identical to SEQ ID NO: 217
  Synthetic sequence-aptamer unique sequence

SEQ ID NO: 529 - DNA, 30 bp, Artificial Sequence; identical to SEQ ID NO: 190
  Synthetic sequence-aptamer unique sequence

SEQ ID NO: 530 - DNA, 30 bp, Artificial Sequence
  Synthetic sequence-aptamer unique sequence
ggacggaacgtgagggcaagtacgtgctcg

SEQ ID NO: 531 - DNA, 30 bp, Artificial Sequence
  Synthetic sequence-aptamer unique sequence
ccatcgcgtcactatcatgtgtgtcacgta

SEQ ID NO: 532 - DNA, 30 bp, Artificial Sequence; identical to SEQ ID NO: 202
  Synthetic sequence-aptamer unique sequence

SEQ ID NO: 533 - DNA, 30 bp, Artificial Sequence; identical to SEQ ID NO: 141
  Synthetic sequence-aptamer unique sequence

SEQ ID NO: 534 - DNA, 30 bp, Artificial Sequence; identical to SEQ ID NO: 232
  Synthetic sequence-aptamer unique sequence

SEQ ID NO: 535 - DNA, 30 bp, Artificial Sequence
  Synthetic sequence-aptamer unique sequence
aatgcggcatgaacggacctacacgtgggc

SEQ ID NO: 536 - DNA, 30 bp, Artificial Sequence; identical to SEQ ID NO: 224
  Synthetic sequence-aptamer unique sequence

SEQ ID NO: 537 - DNA, 30 bp, Artificial Sequence; identical to SEQ ID NO: 163
  Synthetic sequence-aptamer unique sequence

SEQ ID NO: 538 - DNA, 30 bp, Artificial Sequence; identical to SEQ ID NO: 254
  Synthetic sequence-aptamer unique sequence

SEQ ID NO: 539 - DNA, 30 bp, Artificial Sequence
  Synthetic sequence-aptamer unique sequence
ggccagatcgacatagcgagtgagagtgta

SEQ ID NO: 540 - DNA, 30 bp, Artificial Sequence
  Synthetic sequence-aptamer unique sequence
gtcatgcgcgtaccatcgagggggcgtgga

SEQ ID NO: 541 - DNA, 29 bp, Artificial Sequence
  Synthetic sequence-aptamer unique sequence
gcacgccgatgccctcatgtggccgtgga

SEQ ID NO: 542 - DNA, 30 bp, Artificial Sequence
  Synthetic sequence-aptamer unique sequence
gcactgagcgtacgtatcagcgggcacgta

SEQ ID NO: 543 - DNA, 30 bp, Artificial Sequence; identical to SEQ ID NO: 278
  Synthetic sequence-aptamer unique sequence

SEQ ID NO: 544 - DNA, 30 bp, Artificial Sequence
  Synthetic sequence-aptamer unique sequence
gtgctgcgatggattgggagtgtctttggc

SEQ ID NO: 545 - DNA, 30 bp, Artificial Sequence
  Synthetic sequence-aptamer unique sequence
gtacgcggctggatacaagtacggcatgga

SEQ ID NO: 546 - DNA, 30 bp, Artificial Sequence
  Synthetic sequence-aptamer unique sequence
ggacgcgatggatgtggacggtgtggtagt

SEQ ID NO: 547 - DNA, 30 bp, Artificial Sequence
  Synthetic sequence-aptamer unique sequence
gtcatgcacgaacactatcatggcggcatg

SEQ ID NO: 548 - DNA, 30 bp, Artificial Sequence; identical to SEQ ID NO: 240
  Synthetic sequence-aptamer unique sequence

SEQ ID NO: 549 - DNA, 30 bp, Artificial Sequence; identical to SEQ ID NO: 123
  Synthetic sequence-aptamer unique sequence

SEQ ID NO: 550 - DNA, 30 bp, Artificial Sequence
  Synthetic sequence-aptamer unique sequence
gtgctcgcaagacctacacgtggacgtgga

SEQ ID NO: 551 - DNA, 30 bp, Artificial Sequence; identical to SEQ ID NO: 253
  Synthetic sequence-aptamer unique sequence

SEQ ID NO: 552 - DNA, 30 bp, Artificial Sequence
  Synthetic sequence-aptamer unique sequence
tcgatcgatccgtcaagcaggcacgtgtca

SEQ ID NO: 553 - DNA, 30 bp, Artificial Sequence; identical to SEQ ID NO: 237
  Synthetic sequence-aptamer unique sequence

SEQ ID NO: 554 - DNA, 30 bp, Artificial Sequence; identical to SEQ ID NO: 281
  Synthetic sequence-aptamer unique sequence

SEQ ID NO: 555 - DNA, 30 bp, Artificial Sequence
  Synthetic sequence-aptamer unique sequence
ccgcatcggaccgatcaaggcaggcttgga

SEQ ID NO: 556 - DNA, 30 bp, Artificial Sequence
  Synthetic sequence-aptamer unique sequence
tggccaagcgacctagcaagtgtgctcatg

SEQ ID NO: 557 - DNA, 30 bp, Artificial Sequence; identical to SEQ ID NO: 219
  Synthetic sequence-aptamer unique sequence

SEQ ID NO: 558 - DNA, 30 bp, Artificial Sequence
  Synthetic sequence-aptamer unique sequence
gtacgacgcgagctagcaaggaggcgtgta

SEQ ID NO: 559 - DNA, 30 bp, Artificial Sequence
  Synthetic sequence-aptamer unique sequence
ggcatgcacgcacctacacgtgggcacgta

SEQ ID NO: 560 - DNA, 30 bp, Artificial Sequence; identical to SEQ ID NO: 211
  Synthetic sequence-aptamer unique sequence

SEQ ID NO: 561 - DNA, 30 bp, Artificial Sequence; identical to SEQ ID NO: 182
  Synthetic sequence-aptamer unique sequence

SEQ ID NO: 562 - DNA, 30 bp, Artificial Sequence
  Synthetic sequence-aptamer unique sequence
gtgctgcctgacccacgtggacttgcacta

SEQ ID NO: 563 - DNA, 30 bp, Artificial Sequence
  Synthetic sequence-aptamer unique sequence
ggactgacgagccgttcatgtggttgtgga

SEQ ID NO: 564 - DNA, 30 bp, Artificial Sequence
  Synthetic sequence-aptamer unique sequence
cgcaacggtgacgagcagtgagtgcatgta

SEQ ID NO: 565 - DNA, 30 bp, Artificial Sequence
  Synthetic sequence-aptamer unique sequence
ggacggatcgaacctacaagttgtcgtgga

SEQ ID NO: 566 - DNA, 30 bp, Artificial Sequence
  Synthetic sequence-aptamer unique sequence
gtcgtgagctggaaggagagtgggtacgta

SEQ ID NO: 567 - DNA, 30 bp, Artificial Sequence
  Synthetic sequence-aptamer unique sequence
gtcattgtcggatgtgagcatgttctcggc

SEQ ID NO: 568 - DNA, 30 bp, Artificial Sequence; identical to SEQ ID NO: 247
  Synthetic sequence-aptamer unique sequence

SEQ ID NO: 569 - DNA, 30 bp, Artificial Sequence; identical to SEQ ID NO: 275
  Synthetic sequence-aptamer unique sequence

SEQ ID NO: 570 - DNA, 30 bp, Artificial Sequence; identical to SEQ ID NO: 205
  Synthetic sequence-aptamer unique sequence

SEQ ID NO: 571 - DNA, 30 bp, Artificial Sequence; identical to SEQ ID NO: 263
  Synthetic sequence-aptamer unique sequence

SEQ ID NO: 572 - DNA, 30 bp, Artificial Sequence
  Synthetic sequence-aptamer unique sequence
gacacgccgatgagcctagcctgtacgacg

SEQ ID NO: 573 - DNA, 30 bp, Artificial Sequence; identical to SEQ ID NO: 166
  Synthetic sequence-aptamer unique sequence

SEQ ID NO: 574 - DNA, 30 bp, Artificial Sequence
  Synthetic sequence-aptamer unique sequence
gtacgcctcggagctagcaggtggtgtgga

SEQ ID NO: 575 - DNA, 30 bp, Artificial Sequence; identical to SEQ ID NO: 256
  Synthetic sequence-aptamer unique sequence

SEQ ID NO: 576 - DNA, 30 bp, Artificial Sequence
  Synthetic sequence-aptamer unique sequence
gtcatgctctgggtgtgcgaatgtggtagg

SEQ ID NO: 577 - DNA, 30 bp, Artificial Sequence; identical to SEQ ID NO: 221
  Synthetic sequence-aptamer unique sequence

SEQ ID NO: 578 - DNA, 30 bp, Artificial Sequence
  Synthetic sequence-aptamer unique sequence
cgacgcaatcggacactggacatgcgcaga

SEQ ID NO: 579 - DNA, 30 bp, Artificial Sequence
  Synthetic sequence-aptamer unique sequence
gcacgtacgccttgcctatctgtgctcatg

SEQ ID NO: 580 - DNA, 30 bp, Artificial Sequence; identical to SEQ ID NO: 270
  Synthetic sequence-aptamer unique sequence

SEQ ID NO: 581 - DNA, 30 bp, Artificial Sequence
  Synthetic sequence-aptamer unique sequence
catgtgtcgactcgccctatcatgcggtca

SEQ ID NO: 582 - DNA, 30 bp, Artificial Sequence; identical to SEQ ID NO: 255
  Synthetic sequence-aptamer unique sequence

SEQ ID NO: 583 - DNA, 30 bp, Artificial Sequence
  Synthetic sequence-aptamer unique sequence
ggactcgcgtcactatcacgggggcaggta

SEQ ID NO: 584 - DNA, 30 bp, Artificial Sequence
  Synthetic sequence-aptamer unique sequence
gcttcgatggatgctgggcaggcacgcagt

SEQ ID NO: 585 - DNA, 30 bp, Artificial Sequence
  Synthetic sequence-aptamer unique sequence
gacattcgctggatgtggggatgcactgtc

SEQ ID NO: 586 - DNA, 30 bp, Artificial Sequence; identical to SEQ ID NO: 233
  Synthetic sequence-aptamer unique sequence

SEQ ID NO: 587 - DNA, 27 bp, Artificial Sequence
  Synthetic sequence-aptamer unique sequence
gtgcgaccgaccctatcaagtacgtca

SEQ ID NO: 588 - DNA, 30 bp, Artificial Sequence
  Synthetic sequence-aptamer unique sequence
gtgctgaacgtaccgattcaagtgtgcgtg

SEQ ID NO: 589 - DNA, 30 bp, Artificial Sequence
  Synthetic sequence-aptamer unique sequence
ggcctgcgatggaatgtgcgaatgtacgca

SEQ ID NO: 590 - DNA, 30 bp, Artificial Sequence
  Synthetic sequence-aptamer unique sequence
ctcatgcggaccgaactggatgtgtgcatg

SEQ ID NO: 591 - DNA, 30 bp, Artificial Sequence; identical to SEQ ID NO: 227
  Synthetic sequence-aptamer unique sequence

SEQ ID NO: 592 - DNA, 30 bp, Artificial Sequence; identical to SEQ ID NO: 287
  Synthetic sequence-aptamer unique sequence

SEQ ID NO: 593 - DNA, 30 bp, Artificial Sequence
  Synthetic sequence-aptamer unique sequence
ggccgaatgaccgtctcatgtgagcatgga

SEQ ID NO: 594 - DNA, 30 bp, Artificial Sequence
  Synthetic sequence-aptamer unique sequence
ggtccgaacgcacctcatgtgtgtcgtgta

SEQ ID NO: 595 - DNA, 30 bp, Artificial Sequence
  Synthetic sequence-aptamer unique sequence
ggtctgcgcgtaccgtcaagtgcgaatgga

SEQ ID NO: 596 - DNA, 30 bp, Artificial Sequence
  Synthetic sequence-aptamer unique sequence
gtcgtgagcgggtgtgggactggacgcagt

SEQ ID NO: 597 - DNA, 76 bp, Artificial Sequence; identical to SEQ ID NO: 398
  Synthetic sequence-aptamer full sequence

SEQ ID NO: 598 - DNA, 76 bp, Artificial Sequence
  Synthetic sequence-aptamer full sequence
tagggaagagaaggacatatgatggcatgcacgcacctacacgtgggtatggattgactagtacatgaccacttga

SEQ ID NO: 599 - DNA, 76 bp, Artificial Sequence; identical to SEQ ID NO: 297
  Synthetic sequence-aptamer full sequence

SEQ ID NO: 600 - DNA, 76 bp, Artificial Sequence; identical to SEQ ID NO: 464
  Synthetic sequence-aptamer full sequence

SEQ ID NO: 601 - DNA, 76 bp, Artificial Sequence; identical to SEQ ID NO: 406
  Synthetic sequence-aptamer full sequence

SEQ ID NO: 602 - DNA, 76 bp, Artificial Sequence; identical to SEQ ID NO: 311
  Synthetic sequence-aptamer full sequence

SEQ ID NO: 603 - DNA, 76 bp, Artificial Sequence; identical to SEQ ID NO: 445
  Synthetic sequence-aptamer full sequence

SEQ ID NO: 604 - DNA, 76 bp, Artificial Sequence; identical to SEQ ID NO: 344
  Synthetic sequence-aptamer full sequence

SEQ ID NO: 605 - DNA, 76 bp, Artificial Sequence; identical to SEQ ID NO: 346
  Synthetic sequence-aptamer full sequence

SEQ ID NO: 606 - DNA, 76 bp, Artificial Sequence; identical to SEQ ID NO: 429
  Synthetic sequence-aptamer full sequence

SEQ ID NO: 607 - DNA, 76 bp, Artificial Sequence
  Synthetic sequence-aptamer full sequence
tagggaagagaaggacatatgatccgcacgtagccctatcagtggtgcatgcattgactagtacatgaccacttga

SEQ ID NO: 608 - DNA, 76 bp, Artificial Sequence
  Synthetic sequence-aptamer full sequence
tagggaagagaaggacatatgatggcatgcgctgggtagtgatcacgtacggtttgactagtacatgaccacttga

SEQ ID NO: 609 - DNA, 76 bp, Artificial Sequence; identical to SEQ ID NO: 303
  Synthetic sequence-aptamer full sequence

SEQ ID NO: 610 - DNA, 76 bp, Artificial Sequence; identical to SEQ ID NO: 300
  Synthetic sequence-aptamer full sequence

SEQ ID NO: 611 - DNA, 76 bp, Artificial Sequence; identical to SEQ ID NO: 394
  Synthetic sequence-aptamer full sequence

SEQ ID NO: 612 - DNA, 76 bp, Artificial Sequence; identical to SEQ ID NO: 392
  Synthetic sequence-aptamer full sequence

SEQ ID NO: 613 - DNA, 76 bp, Artificial Sequence; identical to SEQ ID NO: 416
  Synthetic sequence-aptamer full sequence

SEQ ID NO: 614 - DNA, 76 bp, Artificial Sequence; identical to SEQ ID NO: 347
  Synthetic sequence-aptamer full sequence

SEQ ID NO: 615 - DNA, 76 bp, Artificial Sequence
  Synthetic sequence-aptamer full sequence
tagggaagagaaggacatatgatgacggtgcgtcctaaagtgctcagtgcgtgttgactagtacatgaccacttga

SEQ ID NO: 616 - DNA, 76 bp, Artificial Sequence; identical to SEQ ID NO: 436
  Synthetic sequence-aptamer full sequence

SEQ ID NO: 617 - DNA, 76 bp, Artificial Sequence
  Synthetic sequence-aptamer full sequence
tagggaagagaaggacatatgatgtgcgacctgacctagcaagcggtagtgtattgactagtacatgaccacttga

SEQ ID NO: 618 - DNA, 76 bp, Artificial Sequence; identical to SEQ ID NO: 308
  Synthetic sequence-aptamer full sequence

SEQ ID NO: 619 - DNA, 76 bp, Artificial Sequence
  Synthetic sequence-aptamer full sequence
tagggaagagaaggacatatgatggccaagctgaccgtaaaggcaggcgtgtattgactagtacatgaccacttga

SEQ ID NO: 620 - DNA, 76 bp, Artificial Sequence; identical to SEQ ID NO: 469
  Synthetic sequence-aptamer full sequence

SEQ ID NO: 621 - DNA, 76 bp, Artificial Sequence; identical to SEQ ID NO: 307
  Synthetic sequence-aptamer full sequence

SEQ ID NO: 622 - DNA, 76 bp, Artificial Sequence
  Synthetic sequence-aptamer full sequence
tagggaagagaaggacatatgatcgcaccgtcaagcgggaaggcactttggtgttgactagtacatgaccacttga

SEQ ID NO: 623 - DNA, 76 bp, Artificial Sequence; identical to SEQ ID NO: 438
  Synthetic sequence-aptamer full sequence

SEQ ID NO: 624 - DNA, 76 bp, Artificial Sequence; identical to SEQ ID NO: 430
  Synthetic sequence-aptamer full sequence

SEQ ID NO: 625 - DNA, 76 bp, Artificial Sequence; identical to SEQ ID NO: 441
  Synthetic sequence-aptamer full sequence

SEQ ID NO: 626 - DNA, 76 bp, Artificial Sequence
  Synthetic sequence-aptamer full sequence
tagggaagagaaggacatatgatggcctgatcgaacctagagagtggcgtggattgactagtacatgaccacttga

SEQ ID NO: 627 - DNA, 76 bp, Artificial Sequence; identical to SEQ ID NO: 322
  Synthetic sequence-aptamer full sequence

SEQ ID NO: 628 - DNA, 76 bp, Artificial Sequence; identical to SEQ ID NO: 417
  Synthetic sequence-aptamer full sequence

SEQ ID NO: 629 - DNA, 76 bp, Artificial Sequence; identical to SEQ ID NO: 390
  Synthetic sequence-aptamer full sequence

SEQ ID NO: 630 - DNA, 76 bp, Artificial Sequence
  Synthetic sequence-aptamer full sequence
tagggaagagaaggacatatgatggacggaacgtgagggcaagtacgtgctcgttgactagtacatgaccacttga

SEQ ID NO: 631 - DNA, 76 bp, Artificial Sequence
  Synthetic sequence-aptamer full sequence
tagggaagagaaggacatatgatccatcgcgtcactatcatgtgtgtcacgtattgactagtacatgaccacttga

SEQ ID NO: 632 - DNA, 76 bp, Artificial Sequence; identical to SEQ ID NO: 402
  Synthetic sequence-aptamer full sequence

SEQ ID NO: 633 - DNA, 76 bp, Artificial Sequence; identical to SEQ ID NO: 341
  Synthetic sequence-aptamer full sequence

SEQ ID NO: 634 - DNA, 76 bp, Artificial Sequence; identical to SEQ ID NO: 432
  Synthetic sequence-aptamer full sequence

SEQ ID NO: 635 - DNA, 76 bp, Artificial Sequence
  Synthetic sequence-aptamer full sequence
tagggaagagaaggacatatgataatgcggcatgaacggacctacacgtgggcttgactagtacatgaccacttga

SEQ ID NO: 636 - DNA, 76 bp, Artificial Sequence; identical to SEQ ID NO: 424
  Synthetic sequence-aptamer full sequence

SEQ ID NO: 637 - DNA, 76 bp, Artificial Sequence; identical to SEQ ID NO: 363
  Synthetic sequence-aptamer full sequence

SEQ ID NO: 638 - DNA, 76 bp, Artificial Sequence; identical to SEQ ID NO: 454
  Synthetic sequence-aptamer full sequence

SEQ ID NO: 639 - DNA, 76 bp, Artificial Sequence
  Synthetic sequence-aptamer full sequence
tagggaagagaaggacatatgatggccagatcgacatagcgagtgagagtgtattgactagtacatgaccacttga

SEQ ID NO: 640 - DNA, 76 bp, Artificial Sequence
  Synthetic sequence-aptamer full sequence
tagggaagagaaggacatatgatgtcatgcgcgtaccatcgagggggcgtggattgactagtacatgaccacttga

SEQ ID NO: 641 - DNA, 75 bp, Artificial Sequence
  Synthetic sequence-aptamer full sequence
tagggaagagaaggacatatgatgcacgccgatgccctcatgtggccgtggattgactagtacatgaccacttga

SEQ ID NO: 642 - DNA, 76 bp, Artificial Sequence
  Synthetic sequence-aptamer full sequence
tagggaagagaaggacatatgatgcactgagcgtacgtatcagcgggcacgtattgactagtacatgaccacttga

SEQ ID NO: 643 - DNA, 76 bp, Artificial Sequence; identical to SEQ ID NO: 478
  Synthetic sequence-aptamer full sequence

SEQ ID NO: 644 - DNA, 76 bp, Artificial Sequence
  Synthetic sequence-aptamer full sequence
tagggaagagaaggacatatgatgtgctgcgatggattgggagtgtctttggcttgactagtacatgaccacttga

SEQ ID NO: 645 - DNA, 76 bp, Artificial Sequence
  Synthetic sequence-aptamer full sequence
tagggaagagaaggacatatgatgtacgcggctggatacaagtacggcatggattgactagtacatgaccacttga

SEQ ID NO: 646 - DNA, 76 bp, Artificial Sequence
  Synthetic sequence-aptamer full sequence
tagggaagagaaggacatatgatggacgcgatggatgtggacggtgtggtagtttgactagtacatgaccacttga

SEQ ID NO: 647 - DNA, 76 bp, Artificial Sequence
  Synthetic sequence-aptamer full sequence
tagggaagagaaggacatatgatgtcatgcacgaacactatcatggcggcatgttgactagtacatgaccacttga

SEQ ID NO: 648 - DNA, 76 bp, Artificial Sequence; identical to SEQ ID NO: 440
  Synthetic sequence-aptamer full sequence

SEQ ID NO: 649 - DNA, 76 bp, Artificial Sequence; identical to SEQ ID NO: 323
  Synthetic sequence-aptamer full sequence

SEQ ID NO: 650 - DNA, 76 bp, Artificial Sequence
  Synthetic sequence-aptamer full sequence
tagggaagagaaggacatatgatgtgctcgcaagacctacacgtggacgtggattgactagtacatgaccacttga

SEQ ID NO: 651 - DNA, 76 bp, Artificial Sequence; identical to SEQ ID NO: 453
  Synthetic sequence-aptamer full sequence

SEQ ID NO: 652 - DNA, 76 bp, Artificial Sequence
  Synthetic sequence-aptamer full sequence
tagggaagagaaggacatatgattcgatcgatccgtcaagcaggcacgtgtcattgactagtacatgaccacttga

SEQ ID NO: 653 - DNA, 76 bp, Artificial Sequence; identical to SEQ ID NO: 437
  Synthetic sequence-aptamer full sequence

SEQ ID NO: 654 - DNA, 76 bp, Artificial Sequence; identical to SEQ ID NO: 481
  Synthetic sequence-aptamer full sequence

SEQ ID NO: 655 - DNA, 76 bp, Artificial Sequence
  Synthetic sequence-aptamer full sequence
tagggaagagaaggacatatgatccgcatcggaccgatcaaggcaggcttggattgactagtacatgaccacttga

SEQ ID NO: 656 - DNA, 76 bp, Artificial Sequence
  Synthetic sequence-aptamer full sequence
tagggaagagaaggacatatgattggccaagcgacctagcaagtgtgctcatgttgactagtacatgaccacttga

SEQ ID NO: 657 - DNA, 76 bp, Artificial Sequence; identical to SEQ ID NO: 419
  Synthetic sequence-aptamer full sequence

SEQ ID NO: 658 - DNA, 76 bp, Artificial Sequence
  Synthetic sequence-aptamer full sequence
tagggaagagaaggacatatgatgtacgacgcgagctagcaaggaggcgtgtattgactagtacatgaccacttga

SEQ ID NO: 659 - DNA, 76 bp, Artificial Sequence
  Synthetic sequence-aptamer full sequencee
tagggaagagaaggacatatgatggcatgcacgcacctacacgtgggcacgtattgactagtacatgaccacttga

SEQ ID NO: 660 - DNA, 76 bp, Artificial Sequence; identical to SEQ ID NO: 411
  Synthetic sequence-aptamer full sequence

SEQ ID NO: 661 - DNA, 76 bp, Artificial Sequence; identical to SEQ ID NO: 382
  Synthetic sequence-aptamer full sequence

SEQ ID NO: 662 - DNA, 76 bp, Artificial Sequence
  Synthetic sequence-aptamer full sequence
tagggaagagaaggacatatgatgtgctgcctgacccacgtggacttgcactattgactagtacatgaccacttga

SEQ ID NO: 663 - DNA, 76 bp, Artificial Sequence
  Synthetic sequence-aptamer full sequence
tagggaagagaaggacatatgatggactgacgagccgttcatgtggttgtggattgactagtacatgaccacttga

SEQ ID NO: 664 - DNA, 76 bp, Artificial Sequence
  Synthetic sequence-aptamer full sequence
tagggaagagaaggacatatgatcgcaacggtgacgagcagtgagtgcatgtattgactagtacatgaccacttga

SEQ ID NO: 665 - DNA, 76 bp, Artificial Sequence
  Synthetic sequence-aptamer full sequence
tagggaagagaaggacatatgatggacggatcgaacctacaagttgtcgtggattgactagtacatgaccacttga

SEQ ID NO: 666 - DNA, 76 bp, Artificial Sequence
  Synthetic sequence-aptamer full sequence
tagggaagagaaggacatatgatgtcgtgagctggaaggagagtgggtacgtattgactagtacatgaccacttga

SEQ ID NO: 667 - DNA, 76 bp, Artificial Sequence
  Synthetic sequence-aptamer full sequence
tagggaagagaaggacatatgatgtcattgtcggatgtgagcatgttctcggcttgactagtacatgaccacttga

SEQ ID NO: 668 - DNA, 76 bp, Artificial Sequence; identical to SEQ ID NO: 447
  Synthetic sequence-aptamer full sequence

SEQ ID NO: 669 - DNA, 76 bp, Artificial Sequence; identical to SEQ ID NO: 475
  Synthetic sequence-aptamer full sequence

SEQ ID NO: 670 - DNA, 76 bp, Artificial Sequence; identical to SEQ ID NO: 405
  Synthetic sequence-aptamer full sequence

SEQ ID NO: 671 - DNA, 76 bp, Artificial Sequence; identical to SEQ ID NO: 463
  Synthetic sequence-aptamer full sequence

SEQ ID NO: 672 - DNA, 76 bp, Artificial Sequence
  Synthetic sequence-aptamer full sequence
tagggaagagaaggacatatgatgacacgccgatgagcctagcctgtacgacgttgactagtacatgaccacttga

SEQ ID NO: 673 - DNA, 76 bp, Artificial Sequence; identical to SEQ ID NO: 366
  Synthetic sequence-aptamer full sequence

SEQ ID NO: 674 - DNA, 76 bp, Artificial Sequence
  Synthetic sequence-aptamer full sequence
tagggaagagaaggacatatgatgtacgcctcggagctagcaggtggtgtggattgactagtacatgaccacttga

SEQ ID NO: 675 - DNA, 76 bp, Artificial Sequence; identical to SEQ ID NO: 456
  Synthetic sequence-aptamer full sequence

SEQ ID NO: 676 - DNA, 76 bp, Artificial Sequence
  Synthetic sequence-aptamer full sequence
tagggaagagaaggacatatgatgtcatgctctgggtgtgcgaatgtggtaggttgactagtacatgaccacttga

SEQ ID NO: 677 - DNA, 76 bp, Artificial Sequence; identical to SEQ ID NO: 421
  Synthetic sequence-aptamer full sequence

SEQ ID NO: 678 - DNA, 76 bp, Artificial Sequence
  Synthetic sequence-aptamer full sequence
tagggaagagaaggacatatgatcgacgcaatcggacactggacatgcgcagattgactagtacatgaccacttga

SEQ ID NO: 679 - DNA, 76 bp, Artificial Sequence
  Synthetic sequence-aptamer full sequence
tagggaagagaaggacatatgatgcacgtacgccttgcctatctgtgctcatgttgactagtacatgaccacttga

SEQ ID NO: 680 - DNA, 76 bp, Artificial Sequence; identical to SEQ ID NO: 470
  Synthetic sequence-aptamer full sequence

SEQ ID NO: 681 - DNA, 76 bp, Artificial Sequence
  Synthetic sequence-aptamer full sequence
tagggaagagaaggacatatgatcatgtgtcgactcgccctatcatgcggtcattgactagtacatgaccacttga

SEQ ID NO: 682 - DNA, 76 bp, Artificial Sequence; identical to SEQ ID NO: 455
  Synthetic sequence-aptamer full sequence

SEQ ID NO: 683 - DNA, 76 bp, Artificial Sequence
  Synthetic sequence-aptamer full sequence
tagggaagagaaggacatatgatggactcgcgtcactatcacgggggcaggtattgactagtacatgaccacttga

SEQ ID NO: 684 - DNA, 76 bp, Artificial Sequence
  Synthetic sequence-aptamer full sequence
tagggaagagaaggacatatgatgcttcgatggatgctgggcaggcacgcagtttgactagtacatgaccacttga

SEQ ID NO: 685 - DNA, 76 bp, Artificial Sequence
  Synthetic sequence-aptamer full sequence
tagggaagagaaggacatatgatgacattcgctggatgtggggatgcactgtcttgactagtacatgaccacttga

SEQ ID NO: 686 - DNA, 76 bp, Artificial Sequence; identical to SEQ ID NO: 433
  Synthetic sequence-aptamer full sequence

SEQ ID NO: 687 - DNA, 73 bp, Artificial Sequence
  Synthetic sequence-aptamer full sequence
tagggaagagaaggacatatgatgtgcgaccgaccctatcaagtacgtcattgactagtacatgaccacttga

SEQ ID NO: 688 - DNA, 76 bp, Artificial Sequence
  Synthetic sequence-aptamer full sequence
tagggaagagaaggacatatgatgtgctgaacgtaccgattcaagtgtgcgtgttgactagtacatgaccacttga

SEQ ID NO: 689 - DNA, 76 bp, Artificial Sequence
  Synthetic sequence-aptamer full sequence
tagggaagagaaggacatatgatggcctgcgatggaatgtgcgaatgtacgcattgactagtacatgaccacttga

SEQ ID NO: 690 - DNA, 76 bp, Artificial Sequence
  Synthetic sequence-aptamer full sequence
tagggaagagaaggacatatgatctcatgcggaccgaactggatgtgtgcatgttgactagtacatgaccacttga

SEQ ID NO: 691 - DNA, 76 bp, Artificial Sequence; identical to SEQ ID NO: 427
  Synthetic sequence-aptamer full sequence

SEQ ID NO: 692 - DNA, 76 bp, Artificial Sequence; identical to SEQ ID NO: 487
  Synthetic sequence-aptamer full sequence

SEQ ID NO: 693 - DNA, 76 bp, Artificial Sequence
  Synthetic sequence-aptamer full sequence
tagggaagagaaggacatatgatggccgaatgaccgtctcatgtgagcatggattgactagtacatgaccacttga

SEQ ID NO: 694 - DNA, 76 bp, Artificial Sequence
  Synthetic sequence-aptamer full sequence
tagggaagagaaggacatatgatggtccgaacgcacctcatgtgtgtcgtgtattgactagtacatgaccacttga

SEQ ID NO: 695 - DNA, 76 bp, Artificial Sequence
  Synthetic sequence-aptamer full sequence
tagggaagagaaggacatatgatggtctgcgcgtaccgtcaagtgcgaatggattgactagtacatgaccacttga

SEQ ID NO: 696 - DNA, 76 bp, Artificial Sequence
  Synthetic sequence-aptamer full sequence
tagggaagagaaggacatatgatgtcgtgagcgggtgtgggactggacgcagtttgactagtacatgaccacttga

SEQ ID NO: 697 - DNA, 10 bp, Artificial Sequence
  Synthetic sequence-complement
ttcgcacaca

SEQ ID NO: 698 - DNA, 10 bp, Artificial Sequence
  Synthetic sequence-complement
acacacggac

SEQ ID NO: 699 - DNA, 10 bp, Artificial Sequence
  Synthetic sequence-complement
cggacttacg

SEQ ID NO: 700 - DNA, 10 bp, Artificial Sequence
  Synthetic sequence-complement
gcccacccac

SEQ ID NO: 701 - DNA, 10 bp, Artificial Sequence
  Synthetic sequence-complement
cccacagatt

SEQ ID NO: 702 - DNA, 10 bp, Artificial Sequence
  Synthetic sequence-complement
agattcgcat

SEQ ID NO: 703 - DNA, 10 bp, Artificial Sequence
  Synthetic sequence-complement
agattcgcat

SEQ ID NO: 704 - DNA, 10 bp, Artificial Sequence
  Synthetic sequence-complement
cgcatccact

SEQ ID NO: 705 - DNA, 10 bp, Artificial Sequence
  Synthetic sequence-complement
ccactcagct

SEQ ID NO: 706 - DNA, 10 bp, Artificial Sequence
  Synthetic sequence-complement
cagctcgacc

SEQ ID NO: 707 - DNA, 10 bp, Artificial Sequence
  Synthetic sequence-complement
cgaccccccc

SEQ ID NO: 708 - DNA, 10 bp, Artificial Sequence
  Synthetic sequence-complement
cccccggtag

SEQ ID NO: 709 - DNA, 10 bp, Artificial Sequence
  Synthetic sequence-complement
ggtagaagcg

SEQ ID NO: 710 - DNA, 10 bp, Artificial Sequence
  Synthetic sequence-complement
aagcggaatg

SEQ ID NO: 711 - DNA, 10 bp, Artificial Sequence
  Synthetic sequence-complement
gaatgtgcga

SEQ ID NO: 712 - DNA, 15 bp, Artificial Sequence
  Synthetic sequence-complement
ttcgcacacacggac

SEQ ID NO: 713 - DNA, 15 bp, Artificial Sequence
  Synthetic sequence-complement
acacacggacttacg

SEQ ID NO: 714 - DNA, 15 bp, Artificial Sequence
  Synthetic sequence-complement
cggacttacggccca

SEQ ID NO: 715 - DNA, 15 bp, Artificial Sequence
  Synthetic sequence-complement
ttacggcccacccac

SEQ ID NO: 716 - DNA, 15 bp, Artificial Sequence
  Synthetic sequence-complement
gcccacccacagatt

SEQ ID NO: 717 - DNA, 15 bp, Artificial Sequence
  Synthetic sequence-complement
cccacagattcgcat

SEQ ID NO: 718 - DNA, 15 bp, Artificial Sequence
  Synthetic sequence-complement
agattcgcatccact

SEQ ID NO: 719 - DNA, 15 bp, Artificial Sequence
  Synthetic sequence-complement
cgcatccactcagct

SEQ ID NO: 720 - DNA, 15 bp, Artificial Sequence
  Synthetic sequence-complement
ccactcagctcgacc

SEQ ID NO: 721 - DNA, 15 bp, Artificial Sequence
  Synthetic sequence-complement
cagctcgaccccccc

SEQ ID NO: 722 - DNA, 15 bp, Artificial Sequence
  Synthetic sequence-complement
cgacccccccggtag

SEQ ID NO: 723 - DNA, 15 bp, Artificial Sequence
  Synthetic sequence-complement
cccccggtagaagcg

SEQ ID NO: 724 - DNA, 15 bp, Artificial Sequence
  Synthetic sequence-complement
ggtagaagcggaatg

SEQ ID NO: 725 - DNA, 15 bp, Artificial Sequence
  Synthetic sequence-complement
aagcggaatgtgcga

SEQ ID NO: 726 - DNA, 20 bp, Artificial Sequence
  Synthetic sequence-complement
ttcgcacacacggacttacg

SEQ ID NO: 727 - DNA, 20 bp, Artificial Sequence
  Synthetic sequence-complement
acacacggacttacggccca

SEQ ID NO: 728 - DNA, 20 bp, Artificial Sequence
  Synthetic sequence-complement
cggacttacggcccacccac

SEQ ID NO: 729 - DNA, 20 bp, Artificial Sequence
  Synthetic sequence-complement
ttacggcccacccacagatt

SEQ ID NO: 730 - DNA, 20 bp, Artificial Sequence
  Synthetic sequence-complement
gcccacccacagattcgcat

SEQ ID NO: 731 - DNA, 20 bp, Artificial Sequence
  Synthetic sequence-complement
cccacagattcgcatccact

SEQ ID NO: 732 - DNA, 20 bp, Artificial Sequence
  Synthetic sequence-complement
agattcgcatccactcagct

SEQ ID NO: 733 - DNA, 20 bp, Artificial Sequence
  Synthetic sequence-complement
cgcatccactcagctcgacc

SEQ ID NO: 734 - DNA, 20 bp, Artificial Sequence
  Synthetic sequence-complement
ccactcagctcgaccccccc

SEQ ID NO: 735 - DNA, 20 bp, Artificial Sequence
  Synthetic sequence-complement
cagctcgacccccccggtag

SEQ ID NO: 736 - DNA, 20 bp, Artificial Sequence
  Synthetic sequence-complement
cgacccccccggtagaagcg

SEQ ID NO: 737 - DNA, 20 bp, Artificial Sequence
  Synthetic sequence-complement
cccccggtagaagcggaatg

SEQ ID NO: 738 - DNA, 20 bp, Artificial Sequence
  Synthetic sequence-complement
ggtagaagcggaatgtgcga

SEQ ID NO: 739 - DNA, 10 bp, Artificial Sequence
  Synthetic sequence-complement
aagtggtcat

SEQ ID NO: 740 - DNA, 10 bp, Artificial Sequence
  Synthetic sequence-complement
gtcatgtact

SEQ ID NO: 741 - DNA, 10 bp, Artificial Sequence
  Synthetic sequence-complement
gtactagtca

SEQ ID NO: 742 - DNA, 10 bp, Artificial Sequence
  Synthetic sequence-complement
agtcaagacg

SEQ ID NO: 743 - DNA, 10 bp, Artificial Sequence
  Synthetic sequence-complement
agacgagcac

SEQ ID NO: 744 - DNA, 10 bp, Artificial Sequence
  Synthetic sequence-complement
agcacaaccc

SEQ ID NO: 745 - DNA, 10 bp, Artificial Sequence
  Synthetic sequence-complement
aacccacatc

SEQ ID NO: 746 - DNA, 10 bp, Artificial Sequence
  Synthetic sequence-complement
acatccatcg

SEQ ID NO: 747 - DNA, 10 bp, Artificial Sequence
  Synthetic sequence-complement
catcgactga

SEQ ID NO: 748 - DNA, 10 bp, Artificial Sequence
  Synthetic sequence-complement
actgacatca

SEQ ID NO: 749 - DNA, 10 bp, Artificial Sequence
  Synthetic sequence-complement
catcatatgt

SEQ ID NO: 750 - DNA, 10 bp, Artificial Sequence
  Synthetic sequence-complement
tatgtccttc

SEQ ID NO: 751 - DNA, 10 bp, Artificial Sequence
  Synthetic sequence-complement
ccttctcttc

SEQ ID NO: 752 - DNA, 9 bp, Artificial Sequence
  Synthetic sequence-complement
tcttcccta

SEQ ID NO: 753 - DNA, 15 bp, Artificial Sequence
  Synthetic sequence-complement
aagtggtcatgtact

SEQ ID NO: 754 - DNA, 15 bp, Artificial Sequence
  Synthetic sequence-complement
gtcatgtactagtca

SEQ ID NO: 755 - DNA, 15 bp, Artificial Sequence
  Synthetic sequence-complement
gtactagtcaagacg

SEQ ID NO: 756 - DNA, 15 bp, Artificial Sequence
  Synthetic sequence-complement
agtcaagacgagcac

SEQ ID NO: 757 - DNA, 15 bp, Artificial Sequence
  Synthetic sequence-complement
agacgagcacaaccc

SEQ ID NO: 758 - DNA, 15 bp, Artificial Sequence
  Synthetic sequence-complement
agcacaacccacatc

SEQ ID NO: 759 - DNA, 15 bp, Artificial Sequence
  Synthetic sequence-complement
aacccacatccatcg

SEQ ID NO: 760 - DNA, 15 bp, Artificial Sequence
  Synthetic sequence-complement
acatccatcgactga

SEQ ID NO: 761 - DNA, 15 bp, Artificial Sequence
  Synthetic sequence-complement
catcgactgacatca

SEQ ID NO: 762 - DNA, 15 bp, Artificial Sequence
  Synthetic sequence-complement
actgacatcatatgt

SEQ ID NO: 763 - DNA, 15 bp, Artificial Sequence
  Synthetic sequence-complement
catcatatgtccttc

SEQ ID NO: 764 - DNA, 15 bp, Artificial Sequence
  Synthetic sequence-complement
tatgtccttctcttc

SEQ ID NO: 765 - DNA, 14 bp, Artificial Sequence
  Synthetic sequence-complement
ccttctcttcccta

SEQ ID NO: 766 - DNA, 20 bp, Artificial Sequence
  Synthetic sequence-complement
aagtggtcatgtactagtca

SEQ ID NO: 767 - DNA, 20 bp, Artificial Sequence
  Synthetic sequence-complement
gtcatgtactagtcaagacg

SEQ ID NO: 768 - DNA, 19 bp, Artificial Sequence
  Synthetic sequence-complement
gtactagtcaagacgagac

SEQ ID NO: 769 - DNA, 20 bp, Artificial Sequence
  Synthetic sequence-complement
agtcaagacgagcacaaccc

SEQ ID NO: 770 - DNA, 20 bp, Artificial Sequence
  Synthetic sequence-complement
agacgagcacaacccacatc

SEQ ID NO: 771 - DNA, 20 bp, Artificial Sequence
  Synthetic sequence-complement
agcacaacccacatccatcg

SEQ ID NO: 772 - DNA, 20 bp, Artificial Sequence
  Synthetic sequence-complement
aacccacatccatcgactga

SEQ ID NO: 773 - DNA, 20 bp, Artificial Sequence
  Synthetic sequence-complement
acatccatcgactgacatca

SEQ ID NO: 774 - DNA, 20 bp, Artificial Sequence
  Synthetic sequence-complement
catcgactgacatcatatgt

SEQ ID NO: 775 - DNA, 20 bp, Artificial Sequence
  Synthetic sequence-complement
actgacatcatatgtccttc

SEQ ID NO: 776 - DNA, 20 bp, Artificial Sequence
  Synthetic sequence-complement
catcatatgtccttctcttc

SEQ ID NO: 777 - DNA, 19 bp, Artificial Sequence
  Synthetic sequence-complement
tatgtccttctcttcccta

SEQ ID NO: 778 - DNA, 10 bp, Artificial Sequence
  Synthetic Sequence
tcaagtggtc

SEQ ID NO: 779 - DNA, 10 bp, Artificial Sequence
  Synthetic Sequence
tggtcatgta

SEQ ID NO: 780 - DNA, 10 bp, Artificial Sequence
  Synthetic Sequence
atgtactagt

SEQ ID NO: 781 - DNA, 10 bp, Artificial Sequence
  Synthetic Sequence
tactagtcaa

SEQ ID NO: 782 - DNA, 10 bp, Artificial Sequence
  Synthetic Sequence
atcatatgtc

SEQ ID NO: 783 - DNA, 10 bp, Artificial Sequence
  Synthetic Sequence
atgtccttct

SEQ ID NO: 784 - DNA, 10 bp, Artificial Sequence
  Synthetic Sequence
cttctcttcc

SEQ ID NO: 785 - DNA, 10 bp, Artificial Sequence
  Synthetic Sequence
ctcttcccta

SEQ ID NO: 786 - DNA, 12 bp, Artificial Sequence
  Synthetic Sequence
catcgactgaca

SEQ ID NO: 787 - DNA, 10 bp, Artificial Sequence
  Synthetic Sequence
ccatcgatgc

SEQ ID NO: 788 - DNA, 13 bp, Artificial Sequence
  Synthetic Sequence
ctacacccacatc

SEQ ID NO: 789 - DNA, 10 bp, Artificial Sequence
  Synthetic Sequence
ttcgcacaca

SEQ ID NO: 790 - DNA, 10 bp, Artificial Sequence
  Synthetic Sequence
acacacggac

SEQ ID NO: 791 - DNA, 10 bp, Artificial Sequence
  Synthetic Sequence
cggacttacg

SEQ ID NO: 792 - DNA, 10 bp, Artificial Sequence
  Synthetic Sequence
ttacggccca

SEQ ID NO: 793 - DNA, 10 bp, Artificial Sequence
  Synthetic Sequence
gcccacccac

SEQ ID NO: 794 - DNA, 10 bp, Artificial Sequence
  Synthetic Sequence
cccacagatt

SEQ ID NO: 795 - DNA, 10 bp, Artificial Sequence
  Synthetic Sequence
agattcgcat

SEQ ID NO: 796 - DNA, 10 bp, Artificial Sequence
  Synthetic Sequence
cgcatccact

SEQ ID NO: 797 - DNA, 10 bp, Artificial Sequence
  Synthetic Sequence
ccactcagct

SEQ ID NO: 798 - DNA, 10 bp, Artificial Sequence
  Synthetic Sequence
cagctcgacc

SEQ ID NO: 799 - DNA, 10 bp, Artificial Sequence
  Synthetic Sequence
cgaccccccc

SEQ ID NO: 800 - DNA, 10 bp, Artificial Sequence
  Synthetic Sequence
cccccggtag

SEQ ID NO: 801 - DNA, 10 bp, Artificial Sequence
  Synthetic Sequence
ggtagaagcg

SEQ ID NO: 802 - DNA, 10 bp, Artificial Sequence
  Synthetic Sequence
aagcggaatg

SEQ ID NO: 803 - DNA, 10 bp, Artificial Sequence
  Synthetic Sequence
gaatgtgcga

SEQ ID NO: 804 - DNA, 26 bp, Artificial Sequence
  Synthetic Sequence
gaaaagtgctcatctgtgaactctat

SEQ ID NO: 805 - protein, 131 aa, Acarus siro (Storage mite)
MVQINGSYKLEKSDNFDAFLKELGLNFVTRNLAKSATPTVEVSVNGDSYTIKTASTLKNTEISFKLGEEFEEARADGKTVKTVVNKESDTKFVQVQQGDKEVTIVREFSDEGLTVTATVNGVTSVRFYKRQ

SEQ ID NO: 806 - protein, 562 aa, Aedes aegypti (Yellow fever mosquito)
MAGRPGYSEVIFLYVVSVAVIARATDNMPVNKDVSKLFPLTLIHINDLHARFEETNMKSNVCTQKDQCIAGIARVYQKIKDLLKEYESKNPIYLNAGDNFQGTLWYNLLRWNVTADFIKKLKPAAMTLGNHEFDHTPKGLAPYLAELNKEGIPTIVANLVMNNDPDLKSSKIPKSIKLTVGKRKIGIIGVLYDKTHEIAQTGKVTLSNAVEAVRREAAALKKDNIDIIVVLSHCSYEEDKKIAAEAGDDIDVIVGAHSHSFLYSPDSKQPHDPKDKVEGPYPTLVESKNKRKIPIVQAKSFGKYVGRLTLYFDEEGEVKNWEGYPVFIDHKVQQDPQILKDLVPWRAKVEAIGSTVVGETMIELDRDSCRDQECTLGVLYADGFADQYTNDTFRPFAIIQAGNFRNPIKVGKITNGDIIEAAPFGSTADLIRLKGADIWDVAEHSFALDDEGRTNCLQVSGLRIVIDISKPVRSRVKKIEVMDYTNPKSDKLKPLDKEAEYYIVVPSYLADGKDGFSAMKRATARRTGPLDSDVFKNYVEKIKKVDNLKLGRVIVCKGSKCT

SEQ ID NO: 807 - protein, 321 aa, Aedes aegypti (Yellow fever mosquito)
MKLPLLLAIVTTFSVVASTGPFDPEEMLFTFTRCMEDNLEDGPNRLPMLAKWKEWINEPVDSPATQCFGKCVLVRTGLYDPVAQKFDASVIQEQFKAYPSLGEKSKVEAYANAVQQLPSTNNDCAAVFKAYDPVHKAHKDTSKNLFHGNKELTKGLYEKLGKDIRQKKQSYFEFCENKYYPAGSDKRQQLCKIRQYTVLDDALFKEHTDCVMKGIRYITKNNELDAEEVKRDFMQVNKDTKALEKVLNDCKSKEPSNAGEKSWHYYKCLVESSVKDDFKEAFDYREVRSQIYAFNLPKKQVYSKPAVQSQVMEIDGKQCPQ

SEQ ID NO: 808 - protein, 273 aa, Aedes aegypti (Yellow fever mosquito)
MKPLVKLFLLFCLVGIVLSRPMPEDEEPVAEGGDDDASGESEGEEETTDDAGGDGGEEENEGEEHAGDKDAGGEDTGKEENTGHDDAGEEDAGEEDAGEEDAGEEDAGEEDAEKEEGEKEDAGDDAGSDDGEEDSTGGDEGEDNAEDSKGSEKNDPADTYRQVVALLDKDTKVDHIQSEYLRSALNNDLQSEVRVPVVEAIGRIGDYSKIQGCFKSMGKDVKKVISEEEKKFKSCMSKKKSEYQCSEDSFAAAKSKLSPITSKIKSCVSSKGR

SEQ ID NO: 809 - protein, 579 aa, Aedes aegypti (Yellow fever mosquito)
MKIFVPLLSFLLAGLTTGLDWWEHGNFYQVYPRSFKDSDGDGIGDLDGVTEKLKYLKDIGMDGVWLSPIFSSPMADFGYDISNFREIQTEYGDLDAFQRLSDKCKQLGLHLILDFVPNHTSDQHEYFKKSVQKDETYKDFYVWHPGVHGPNNTKVPPSNWISVFRGSSWEWNEERQEFYLHQFLKEQPDLNYRNPAVVEEMKNVLRYWLDRGVSGFRIDAVPYLFESDIIDGRYRNEPESRTTDDPENPAYLVHTQTMDQPETYDMIYQWRAVLDEYSKTDNRTRIMMTEGYTSLPKIIEFFGNATANGAQIPFNFEVISNVKKNSTGADFATYVKRWLDAKPANRRSNWVLGNHDNNRLGSRLGENKIDLYNIALQTLPDIAVTYYGEEIGMLDQWIPWNETVDPAACRSDEASYSAYSRDPARTPMQWDSGKNAGFSKAAKTWLPVADNYKTLNVKIQDRARKSHLKIFKKLTKYRKRQILTEGDIDIKVSGENLLVYKRKVDKVGYVVVALNFGTEPVALGLSSLFDRADQRMQVVVSSNRVSTPDNVWVDVDNYVLIGESGIVLQYLWGKNPIVS

SEQ ID NO: 810 - protein, 191 aa, Aedes aegypti (Yellow fever mosquito)
MSYPWEKRVEFIVGHMYDIDNNGFLDNNDFMCMALRATVVEGKGTINPARLNEYRTIMKALWDEISALADLDHDGKITTEEFKDAVKATCVGKSYSDFPKAMKAFIDAHYQMMDINNDGLVSIEEYRYNCISRIAMDDIKKVDDSYNQLVSDEDNKRGGITLQRYQELYAQFMGNESDKCAAIFLYGPIPE

SEQ ID NO: 811 - protein, 282 aa, Aedes aegypti (Yellow fever mosquito)
MAPPAYADLGKQARDVFNKGYHFGLWKLDVKTKTNSGVEFNTSGSSNQDNGKVFGSLETKYKVKEYGLNFSEKWNTDNTLTSEVSVENQLVKGLKLSFDGSFAPQTGSKTGRFKTAYSHDKVRVDADVNVDLAGPLVNASGVFNYQGWLAGYQVAFDSQKSKVTANNFALGYSTGDFVLHTNVNDGREFGGLIYQRCNDRLETAVQLSWASGSNATKFGLGAKYDLDKDACVRAKVNNQSQIGLGYQQKLRDGVTLTLSTMIDGKSFNTGGHKIGVALELEA

SEQ ID NO: 812 - protein, 204 aa, Aedes aegypti (Yellow fever mosquito)
MAGSENQEVPANEEEISGQEDAEEEESSEEEAPPAPQPAPKSKEKAKSKFVLLHEFIRETDNFLARFDDLVENRDQQKTLYMARTNPLRETLVTLLLRFIQNELPRDDYLYKHIKCCDEEPLNNEEFAEHYEEAHKKDDEGKTSPELDAITAYNEVCKFYIAEGKVVNVDLLFKLRRLLRKTNTVMGGVLLDTTEAIAAQMKKE

SEQ ID NO: 813 - protein, 655 aa, Aedes aegypti (Yellow fever mosquito)
MKLLVPLALVAAVAVLTCTAEEKKEQDYGTVVGIDLGTTYSCVGVYKNGRVEIIANDQGNRITPSYVAFTADGERLIGDAAKNQLTTNPENTVFDAKRLIGREFTDSTVQHDAKLLPFKVIEKNSKPHIKVSTSQGDKVFAPEEISAMVLGKMKETAEAYLGKKVTHAVVTVPAYFNDAQRQATKDAGVIAGLNVMRIINEPTAAAIAYGLDKKDGEKNVLVFDLGGGTFDVSLLTIDNGVFEVVATNGDTHLGGEDFDQRVMDHFIKLYKKKKGKDIRKDNRAVQKLRREVEKAKRALSSSHQVRIEIESFYEGDDFSETLTRAKFEELNMDLFRSTMKPVQKVLEDADMNKKDVDEIVLVGGSTRIPKVQQLVKEFFNGKEPSRGINPDEAVAYGAAVQAGVLSGEQDTEAIVLLDVNPLTMGIETVGGVMTKLIPRNTVIPTKKSQIFSTASDNQHTVTIQVYEGERPMTKDNHLLGKFDLTGIPPAPRGIPQIEVSFEIDANGILQVSAEDKGTGNREKIVITNDQNRLTPEDIERMIKDAERFADDDKKLKERVEARNELESYAYSLKNQLGDKDKLGAKVADDDKATMEEAIDEKIKWLDENQDADSEDYKKQKKELEDVVQPIIAKLYASTGGSPPPTADDEDLKDEL

SEQ ID NO: 814 - protein, 285 aa, Aedes aegypti (Yellow fever mosquito)
MDAIKKKMQAMKLEKDNALDRALLCEQQARDANLRAEKAEEEARQLQKKIQAIENDLDQTQEALMAVNAKLEEKEKALQNAESEVAALNRRIQLLEEDLERSEERLASATAKLSEASAAADESERARKVLENRALADEERMDALENQLKEARFMAEEADKKYDEVARKLAMVEADLERAEERAEAGEGKIVELEEELRVVGNNLKSLEVSEEKANQREEEYKNQIKTLTTRLKEAEARAEFAERSVQKLQKEVDRLEDELVMEKEKYREIGDDLDTAFVELILKE

SEQ ID NO: 815 - protein, 284 aa, Aedes aegypti (Yellow fever mosquito)
MDAIKKKMQAMKLEKDNAADKADTCENQAKEANLRADKIMEEVAELTKRLTQVTEDHEKFKNTLEQANKDLEEKEKLLTSTEANVAALTRKVQQVEEDLEKSEERSGAALSKLLEATQSADENNRMCKVLENRSQQDEERMDQLSNQLKEARMLAEDADGKSDEVSRKLAFVEDELEVAEDRVKSGEAKIMELEEELKVVGNSLKSLEVSEDKANQRVEEFKRQLKSLTIKLKEAETRAENAEKNVKKLQKEVDRLEDKLMNEKDKYKAICDDLDSTFAELTGY

SEQ ID NO: 816 - protein, 387 aa, Aedes aegypti (Yellow fever mosquito)
MLIKSIIALVCLAVLAQADFVRVQLHKTESARQHFRNVDTEIKQLRLKYNAVSGPVPEPLSNYLDAQYYGAITIGTPPQSFKVVFDTGSSNLWVPSKECSFTNIACLMHNKYNAKKSSTFEKNGTAFHIQYGSGSLSGYLSTDTVGLGGVSVTKQTFAEAINEPGLVFVAAKFDGILGLGYSSISVDGVVPVFYNMFNQGLIDAPVFSFYLNRDPSAAEGGEIIFGGSDSNKYTGDFTYLSVDRKAYWQFKMDSVKVGDTEFCNNGCEAIADTGTSLIAGPVSEVTAINKAIGGTPIMNGEYMVDCSLIPKLPKISFVLGGKSFDLEGADYVLRVAQMGKTICLSGFMGIDIPPPNGPLWILGDVFIGKYYTEFDMGNDRVGFATAV

SEQ ID NO: 817 - protein, 134 aa, Apis cerana (Asiatic honey bee)
IIYPGTLWCGHGNVSSGPNELGRFKHTDACCRTHDMCPDVMSAGESKHGLTNTASHTRLSCDCDDTFYDCLKNSGDKISSYFVGKMYFNLIDTKCYKLEHPVTGCGERTEGRCLRYTVDKSKPKAYQWFDLRKY

SEQ ID NO: 818 - protein, 134 aa, Apis dorsata (Giant honeybee)
IIYPGTLWCGHGNVSSSPDELGRFKHTDSCCRSHDMCPDVMSAGESKHGLTNTASHTRLSCDCDDKFYDCLKNSSDTISSYFVGEMYFNILDTKCYKLEHPVTGCGKRTEGRCLNYTVDKSKPKVYQWFDLRKY

SEQ ID NO: 819 - protein, 167 aa, Apis mellifera (Honey bee)
MQVVLGSLFLLLLSTSHGWQIRDRIGDNELEERIIYPGTLWCGHGNKSSGPNELGRFKHTDACCRTHDMCPDVMSAGESKHGLTNTASHTRLSCDCDDKFYDCLKNSADTISSYFVGKMYFNLIDTKCYKLEHPVTGCGERTEGRCLHYTVDKSKPKVYQWFDLRKY

SEQ ID NO: 820 - protein, 382 aa, Apis mellifera (Honey bee)
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 821 - protein, 388 aa, Apis mellifera (Honey bee)
MSVIAILAMVVGVQAELKQINVIFRHGDRIPDEKNEMYPKDPYLYYDFYPLERGELTNSGKMREYQLGQFLRERYGDFLGDIYTEESVSALSSFYDRTKMSLQLVLAALYPPNKLQQWNEDLNWQPIATKYLRRYEDNIFLPEDCLLFTIELDRVLESPRGKYEFSKYDKLKKKLEEWTGKNITTPWDYYYIYHTLVAEQSYGLTLPSWTNNIFPRGELFDATVFTYNITNSTPLLKKLYGGPLLRIFTKHMLDVVSGTQKKKRKIYLFSGHESNIASVLHALQLYYPHVPEYSSSIIMELHNIEGTHYVKIVYYLGIPSEARELQLPGCEVLCPLYKYLQLIENVIPSNEELICDKRFVDESANNLSIEELDFVKLNLIRIAGTENK

SEQ ID NO: 822 - protein, 70 aa, Apis mellifera (Honey bee)
MKFLVNVALVFMVVYISYIYAAPEPEPAPEPEAEADAEADPEAGIGAVLKVLTTGLPALISWIKRKRQQG

SEQ ID NO: 823 - protein, 775 aa, Apis mellifera (Honey bee)
MEVLVQLALLLVVHGSLVVLVAGKSVPRVIDQDLERYEPLEEEDHRGARVPFNLEETYDQSFRANSFNGTWKTDREILYSDNYVGDIRLFDVTTGSGTVLLDSSVTADFDKASVMFSFDNSHVAIGHDYVNGFRYSIHQKCTVYNIKSRTFTDIANGDRIPLFKWSPTRNALIYVHKNDIYYQVFFEGGSDTRRITNTGVPDIVFNGIPDWVYEEEVLGSPVAFWISPDGRHLAFATFNDTNVRDIVISKYGSPGNSRDQYPNEIRIKYPKAGTTNPFVSLSVIDLHDPSSKLIDLPPPVDVVGADNVLYTANWRRDGEIVATWTNRVQNKAQLVLYDTKGNANNIYYEEETEGWLRIQPPLYHDRYVIVAKLQDSGTKAGRFLHATRLEYRNGALVDETDLTPGTCEVISLLLVDHARARLYYLGTELGKPSHKNLYSVQLSGNEPPVCLSCDVLTPEGNRCTYAYAYFSTNGSHYALYCAGPDPVFIAIVNANHRQISIWEENRSLRRKLAARTQPIVKNFNVNANGYTNKVKLYLPPDFDETKKYPLLITVYAGPNTIRITEEATYGFESYIVTNRSVIYGRIDGRGSAYKGSKMLFEIYRRLGTVEIEDQIIITRTLQEKYSWIDSNRTGIWGWSYGGFSAAMVLATDAESVFKCGISVAPVTSWIYYDSLYTERFMGLPTPEDNQSGYNDTDVSRRVEGMRGKKYMLIHGTADDNVHYQQTMMLNKALVNSDIMFQQQTYTDEAHALGNVFPHLYHTTDRFWANCLGYSH

SEQ ID NO: 824 - protein, 92 aa, Apis mellifera (Honey bee)
MSRLVLASFLLLAIFSMLVGGFGGFGGFGGLGGRGKCPSNEIFSRCDGRCQRFCPNVVPKPLCIKICAPGCVCRLGYLRNKKKVCVPRSKCG

SEQ ID NO: 825 - protein, 405 aa, Apis mellifera (Honey bee)
MIFTNNIAAFQNVVLVKKVKIVLLIFYGSIMFSMTQVNKEECDYYQNLNLGEIYYIYNPRYPLPYSGSKCTWTITSYHRINLKCSLVEFSENKNCNAGSLTVKKNFANKYCGNITLNIESTSNKMTVILTPPGRFFCEVRPIKRVKDSTNCNCGWKNPSRIVGGTNTGINEFPMMAGIKRTYEPGMICGATIISKRYVLTAAHCIIDENTTKLAIVVGEHDWSSKTETNATVLHSINKVIIHPKYDIIEKDDWQINDIALLKTEKDIKFGDKVGPACLPFQHFLDSFAGSDVTVLGWGHTSFNGMLSHILQKTTLNMLTQVECYKYYGNIMVNAMCAYAKGKDACQMDSGGPVLWQNPRTKRLVNIGIISWGAECGKYPNGNTKVGSYIDWIVSQTPDAEYCVIE

SEQ ID NO: 826 - protein, 557 aa, Apis mellifera (Honey bee)
MYMLKLSYILLFLGFVKFSWQDKQVPKVSTFTGNIRGYYKKSRSDRLYEAYEGIPYAQSPVGKFRFQPPRPIKKWSKDLSATKKSSVCMQYLMTFTTHGNRVKGSEDCLYINIYVPVRNNRKPLLPVMFWIHGGAFQFASGNEANETLFMDRNIVFVAINYRLGPFGFLSTGDIVVPGNMGLKDQSMALRWVFNNIKSFGGNPNKITIFGMSAGGASVHYHYLSPMSAGLFKRGISISGVAFCPWAQTKHAPEKAKKLGALMKCRTDNTKKMIDCLQSRPARIIAQAVGDFMFWLYNPFTPFGPVVETYGSNPFISNSPINIINNGQVYDVPWISGVVSKEGLYTAAEFVDNAKLLWHLNDHWDEIAPYLLDFNYTIPLDQHRQVAKKIKNYYLRSGPINYDKVESIIQMMSDRLFNIDFEKAVRLQARINKSPVWTYYYSYRAEHSVSEILSGGSTTDYGVCHGDDIFLTLNSIISNVTKPQDLAMQQLLINFYTSFAIQGIPYIDEASWPSLNPNDPDFRYLHIVNFTNIKMEVNNNFANKSFWKTIPFNENKLN

SEQ ID NO: 827 - protein, 467 aa, Apis mellifera (Honey bee)
MKKLVLLQFLFFISFARGFTNVYPKPKYCPLLHEEDAGIPLFLTPLIENGKIDEARNKAVIQHKEVEAISSYAGFLTVNKKYNSNMFFWFFPALHDPKTAPVVLWLQGGPGATSMYGLFLENGPFIVTKNKTLKMREYSWNKCHNLLYIDNPVGTGFSFTEDERGYATNETHVGRDVHTALVQFFELFPELQTNDFYVTGESYGGKYVPAVSHAIKDYNIKAKIKINLKGLAIGNGLTDPVNQLDYGDYLYQLGLLDANGRNLFQKYEEQGKNLIKQEKWLEAFDLFDELLDGDITQQPSLYKNLTGFDYYFNYLHEKDPSNDSDYMVEWLQRADVRKAIHVGNRTFIPESKKVEKYMKADVMQSLAVLIADLTQHYRVLIYNGQLDIIVAYPLTENYLQKLKWPGAEKYKTAQRKVWFVGNELAGYSKTVDSLTEVLVRNAGHMVPLDQPKWALDLITRFTHNKGF

SEQ ID NO: 828 - protein, 223 aa, Apis mellifera (Honey bee)
MKTLGVLFIAAWFIACTHSFPGAHDEDSKEERKNVDTVLVLPSIERDQMMAATFDFPSLSFEDSDEGSNWNWNTLLRPNFLDGWYQTLQSAISAHMKKVREQMAGILSRIPEQGVVNWNKIPEGANTTSTTKIIDGHVVTINETTYTDGSDDYSTLIRVRVIDVRPQNETILTTVSSEADSDVTTLPTLIGKNETSTQSSRSVESVEDFDNEIPKNQGDVLTA

SEQ ID NO: 829 - protein, 415 aa, Apis mellifera (Honey bee)
MIRWLLLMYLGIAVRCYRHSFENLTNSLKVIYEWKYIDYDFGSDEKRQAAIQSGDYNYTMNYLLDTDQWGDKTFVIIMKFNGVPSSLNVITNKTGNGGPLLAPYPDWTWAKNENCSGITSAYKIEIDMCDRLWVLDSGLINNVRSVCPPQLFVFDLNTSQLLKQVKIPHDIAVNTTTGKGALVTLSVQLLSCEVNGSTLVYIGDNEGFALIIYNNSDNSFQRLTSSTFASDPRYTTFTINGESFTLQSGIFGMALSPLTQNLYYSALSSHNLNYVNTEQFVKSQYQANNVHYQGKENILWTQASAKGISDNGVLFFGLVGDTSLACWNENRLLDRRNIEVVAKNKETLQAITGLKVKRRISFILVHGFPLEYEYVLAVSNRIQKVIYGFDFNDVNFRILIANVNDLIKNTRCISP

SEQ ID NO: 830 - protein, 423 aa, Apis mellifera (Honey bee)
MSFNIWWLILYFSIVCQAKAHYSLRDFKANIFQVKYQWKYFDYNFGSDEKRQAAIQSGEYNYKNNVPIDVDRWNGKTFVTILRNDGVPSSLNVISNKIGNGGPLLEPYPNWSWAKNQNCSGITSVYRIAIDEWDRLWVLDNGISGETSVCPSQIVVFDLKNSKLLKQVKIPHDIAINSTTGKRNVVTPIVQSFDYNNTWVYIADVEGYALIIYNNADDSFQRLTSSTFVYDPRYTKYTINDESFSLQDGILGMALSHKTQNLYYSAMSSHNLNYVNTKQFTQGKFQANDIQYQGASDILWTQASAKAISETGALFFGLVSDTALGCWNENRPLKRRNIEIVAKNNDTLQFISGIKIIKQISSNIYERQNNEYIWIVSNKYQKIANGDLNFNEVNFRILNAPVNQLIRYTRCENPKTNFFSIFL

SEQ ID NO: 831 - protein, 1770 aa, Apis mellifera (Honey bee)
MLLLLTLLLFAGTVAADFQHNWQVGNEYTYLVRSRTLTSLGDLSDVHTGILIKALLTVQAKDSNVLAAKVWNGQYARVQQSMPDGWETEISDQMLELRDLPISGKPFQIRMKHGLIRDLIVDRDVPTWEVNILKSIVGQLQVDTQGENAVKVNSVQVPTDDEPYASFKAMEDSVGGKCEVLYDIAPLSDFVIHRSPELVPMPTLKGDGRHMEVIKIKNFDNCDQRINYHFGMTDNSRLEPGTNKNGKFFSRSSTSRIVISESLKHFTIQSSVTTSKMMVSPRLYDRQNGLVLSRMNLTLAKMEKTSKPLPMVDNPESTGNLVYIYNNPFSDVEERRVSKTAMNSNQIVSDNSLSSSEEKLKQDILNLRTDISSSSSSISSSEENDFWQPKPTLEDAPQNSLLPNFVGYKGKHIGKSGKVDVINAAKELIFQIANELEDASNIPVHATLEKFMILCNLMRTMNRKQISELESNMQISPNELKPNDKSQVIKQNTWTVFRDAITQTGTGPAFLTIKEWIERGTTKSMEAANIMSKLPKTVRTPTDSYIRSFFELLQNPKVSNEQFLNTAATLSFCEMIHNAQVNKRSIHNNYPVHTFGRLTSKHDNSLYDEYIPFLERELRKAHQEKDSPRIQTYIMALGMIGEPKILSVFEPYLEGKQQMTVFQRTLMVGSLGKLTETNPKLARSVLYKIYLNTMESHEVRCTAVFLLMKTNPPLSMLQRMAEFTKLDTNRQVNSAVKSTIQSLMKLKSPEWKDLAKKARSVNHLLTHHEYDYELSRGYIDEKILENQNIITHMILNYVGSEDSVIPRILYLTWYSSNGDIKVPSTKVLAMISSVKSFMELSLRSVKDRETIISAAEKIAEELKIVPEELVPLEGNLMINNKYALKFFPFDKHILDKLPTLISNYIEAVKEGKFMNVNMLDTYESVHSFPTETGLPFVYTFNVIKLTKTSGTVQAQINPDFAFIVNSNLRLTFSKNVQGRVGFVTPFEHRHFISGIDSNLHVYAPLKISLDVNTPKGNMQWKIWPMKGEEKSRLFHYSVVPFVSNHDILNLRPLSMEKGTRPMIPDDNTSLALPKNEGPFRLNVETAKTNEEMWELIDTEKLTDRLPYPWTMDNERYVKVDMYMNLEGEQKDPVIFSTSFDSKVMTRPDTDSENWTPKMMAVEPTDKQANSKTRRQEMMREAGRGIESAKSYVVDVRVHVPGESESETVLTLAWSESNVESKGRLLGFWRVEMPRSNADYEVCIGSQIMVSPETLLSYDEKMDQKPKMDFNVDIRYGKNCGKGERIDMNGKLRQSPRLKELVGATSIIKDCVEDMKRGNKILRTCQKAVVLSMLLDEVDISMEVPSDALIALYSQGLFSLSEIDNLDVSLDVSNPKNAGKKKIDVRAKLNEYLDKADVIVNTPIMDAHFKDVKLSDFGFSTEDILDTADEDLLINNVFYEDETSCMLDKTRAQTFDGKDYPLRLGPCWHAVMTTYPRINPDNHNEKLHIPKDKSVSVLSRENEAGQKEVKVLLGSDKIKFVPGTTSQPEVFVNGEKIVVSRNKAYQKVEENEIIFEIYKMGDRFIGLTSDKFDVSLALDGERVMLKASEDYRYSVRGLCGNFDHDSTNDFVGPKNCLFRKPEHFVASYALISNQCEGDSLNVAKSLQDHDCIRQERTQQRNVISDSESGRLDTEMSTWGYHHNVNKHCTIHRTQVKETDDKICFTMRPVVSCASGCTAVETKSKPYKFHCMEKNEAAMKLKKRIEKGANPDLSQKPVSTTEELTVPFVCKA

SEQ ID NO: 832 - protein, 224 aa, Archaeopotamobius sibiriensis (Crustacean species decapod)
GGNWKMNGDRASIDSIISFMKGPLSGDTEVVVGCPQCYLMYTREHLPSNIGVAAQNCYKVAKGAFTGEISPSMIKDCGCEWVILGHSERRNVFNEPDTLISEKVGHALEAGLKVIPCIGEKLEERESNRTEEVVFAQMKALVPNISDWSRVVIAYEPVWAIGTGKTATPEQAQEVHAKLRQWLRDNVNAEVADSTRIIYGGSVTPGNCKELAKTGDIDGFLVGG

SEQ ID NO: 833 - protein, 159 aa, Argas reflexus (Pigeon tick)
MALIILLVACLSVVSADDCSGKTDAWTSIKGPKTGGYWLKQTTKTGENECTYVKGTDFKENTKTATYTYGYKDASGKLTKTTGTATAKGSDIVVGSDTSTVIYTDGKTCDVVKHGGHTELWVHSSKTSGGYNNCCDKKFTETRGSTPANEVYKKCPGMP

SEQ ID NO: 834 - protein, 144 aa, Artemia franciscana (Brine shrimp)
MAFSFTILMETRQLMAFYLGDCLRALNLNPTLAQIEKLGGTKKKNEKKLKVEEFLPIFSQVKKEKDHGTLEDFIECMKLYDKSENGTMMLAELNHILLALGEKLEDSQVDSIFKECMDPEDDEGNIPYTPFLKRLLAGPYPDAQ

SEQ ID NO: 835 - protein, 412 aa, Blattella germanica (German cockroach)
NLLEKLREKGVDVDKIIELIRALFGLTLNAKASRNLQDDLQDFLALIPVDQIIAIATDYLANDAEVQAAVAYLQSDEFETIVVALDALPELQNFLNFLEANGLNAIDFLNGIHDLLGIPHIPVSGRKYHIRRGVGITGLIDDVLAILPIEDLKALFNEKLETSPDFLALYNAIRSPEFQSIVQTLNAMPEYQNLLQKLREKGVDVDKIIELIRALFGLTLNGKASRNLQDDLQDFLALIPVDQIIAIATDYLANDAEVQAAVAYLQSDEFETIVVTLDALPELQNFLNFLEANGLNAIDFLNGIHDLLGIPHIPVSGRKYHIRRGVGITGLIDDVLAILPLDDLKALFNEKLETSPDFLALYNAIKSPEFQSIVQTLNAMPEYQNLLEKLREKGVDVDKIIELIRALFGLTH

SEQ ID NO: 836 - protein, 492 aa, Blattella germanica (German cockroach)
NAIEFLNNIHDLLGIPHIPVTARKHHRRGVGITGLIDDIIAILPVDDLYALFQEKLETSPEFKALYDAIRSPEFQSIVGTLEAMPEYQNLIQKLKDKGVDVDHIIELIHQIFNIVRDTRGLPEDLQDFLALIPTDQVLAIAADYLANDAEVKAAVEYLKSDEFETIVVTVDSLPEFKNFLNFLQTNGLNAIEFLNNIHDLLGIPHIPVTGRKHLRRGVGITGLIDDIIAILPVDDLYALFQEKLETSPEFKALYDAIRSPEFQSIVETLKAMPEYQSLIQKLKDKGVDVDHIIELIHQIFNIVRDTRGLPEDLQDFLALIPIDQILAIAADYLANDAEVQAAVEYLKSDEFETIVVTVDSLPEFKNFLNFLQTNGLNAIEFINNIHDLLGIPHIPATGRKHVRRGVGINGLIDDVIAILPVDELYALFQEKLESSPEFKALYDAIRSPEFQSIVQTLKAMPEYQDLIQRLKDKGVDVDHFIELIKKLFGLSH

SEQ ID NO: 837 - protein, 352 aa, Blattella germanica (German cockroach)
MIGLKLVTVLFAVATITHAAELQRVPLYKLVHVFINTQYAGITKIGNQNFLTVFDSTSCNVVVASQECVGGACVCPNLQKYEKLKPKYISDGNVQVKFFDTGSAVGRGIEDSLTISNLTTSQQDIVLADELSQEVCILSADVVVGIAAPGCPNALKGKTVLENFVEENLIAPVFSIHHARFQDGEHFGEIIFGGSDWKYVDGEFTYVPLVGDDSWKFRLDGVKIGDTTVAPAGTQAIIDTSKAIIVGPKAYVNPINEAIGCVVEKTTTRRICKLDCSKIPSLPDVTFVINGRNFNISSQYYIQQNGNLCYSGFQPCGHSDHFFIGDFFVDHYYSEFNWENKTMGFGRSVESV

SEQ ID NO: 838 - protein, 657 aa, Blattella germanica (German cockroach)
IPADKVFLRKQWDVLRLVHRIHQHSIIPEQVTVGDSYDIEANINNYKNPRVVKNFMALYKKDPVKRGEPFSTYYIKHREQAIMLFELFYYANDYDTFYKTACWARDRVNEGMFLYSFNIAIMHREDMQDIVVPAFYEIYPFLFVENDVIQKAYDYKMKESGHLNEPHTHVIPVNFTLRNQEQLLSYFTEDVFLNAFNTYFRYMYPTWFNYTKYEYDVPRHGEQFYYFNQQMFARYMLERYSNDMPEIQPFTYTKPFKTPYNPQLRYPNGQEVPARPAYMMPQDFDLMYVSDIKNYEKRVADAVDFGYVFCDKMISHSLYNNEKGLEWLGQIVEGNSMHPDFYGHIFHMYRSLLGHITDPFHKHGVAPSALEHPETSLRDPAFYQIWKRVQHYFNKFQMKQPYYTREELAFDGVKIDNVDVGKLYTYFEPYEMGLSNAVKVGKLEDVPNVDIRARNYRLNHKPFTYNVEVTSEKDTPVYVRVFLGPKYNYYGHEYDLNERRNYFVEIDRFPYQLHTGKNTIQRNSHDSSVVAQEQDTYKVLYKKVNEAYEGKTTYTYEKQDKYCGLPEHLLIPKGKKGGQAFTVYVIVTPYDKAVEKEEHHFKAYSYCGVGPHDSVYDKKPLGFPFDRPIHSYDFVTPNMFMKDVFIFHKKYEEVEQH

SEQ ID NO: 839 - protein, 182 aa, Blattella germanica (German cockroach)
AVLALCATDTLANEDCFRHESLVPNLDYERFRGSWIIAAGTSEALTQYKCWIDRFSYDDALVSKYTDSQGKNRTTIRGRTKFEGNKFTIDYNDKGKAFSAPYSVLATDYENYAIVEGCPAAANGHVIYVQIRFSVRRFHPKLGDKEMIQHYTLDQVNQHKKAIEEDLKHFNLKYEDLHSTCH

SEQ ID NO: 840 - protein, 204 aa, Blattella germanica (German cockroach)
MAPSYKLTYCPVKALGEPIRFLLSYGEKDFEDYRFQEGDWPNLKPSMPFGKTPVLEIDGKQTHQSVAISRYLGKQFGLSGKDDWENLEIDMIVDTISDFRAAIANYHYDADENSKQKKWDPLKKETIPYYTKKFDEVVKANGGYLAAGKLTWADFYFVAILDYLNHMAKEDLVANQPNLKALREKVLGLPAIKAWVAKRPPTDL

SEQ ID NO: 841 - protein, 151 aa, Blattella germanica (German cockroach)
MDELPPEQIQLLKKAFDAFDREKKGCISTEMVGTILEMLGHRLDDDMLQEIIAEVDADGSGELEFEEFVSLASRFLVEEDAEAMQQELREAFRLYDKEGNGYITTNVLREILKELDDKITAEDLDMMIEEIDSDGSGTVDFDEFMEVMTGE

SEQ ID NO: 842 - protein, 151 aa, Blattella germanica (German cockroach)
MDEIPAEQVVLLKKAFDAFDREKKGCISTEMVGTILEMLGTRLDQDMLDEIIAEVDADGSGELEFEEFCTLASRFLVEEDAEAMQHELREAFRLYDKEGNGYITTAVLREILKELDDKITAEDLDMMIEEIDSDGSGTVDFDEFMEVMTGE

SEQ ID NO: 843 - protein, 154 aa, Blattella germanica (German cockroach)
MADEQLQLPPEQISVLRKAFDAFDREKSGSISTNMVEEILRLMGQPFNRRTLEELIDEVDADKSGRLEFDEFVTLAAKFIIEEDSEAMEKELREAFRLYDKEGNGYIPTSCLREILRELDEQLTSDELDMMIEEIDADGSGTVDFDEFMEMMTG

SEQ ID NO: 844 - protein, 284 aa, Blattella germanica (German cockroach)
MDAIKKKMQAMKLEKDNAMDRALLCEQQARDANIRAEKAEEEARSLQKKIQQIENDLDQTMEQLMQVNAKLDEKDKALQNAESEVAALNRRIQLLEEDLERSEERLATATAKLAEASQAADESERARKILESKGLADEERMDALENQLKEARFMAEEADKKYDEVARKLAMVEADLERAEERAETGESKIVELEEELRVVGNNLKSLEVSEEKANLREEEYKQQIKTLNTRLKEAEARAEFAERSVQKLQKEVDRLEDELVHEKEKYKYICDDLDMTFTELIGN

SEQ ID NO: 845 - protein, 195 aa, Blattella germanica (German cockroach)
KAKEEAPAAEAAPAPAPAAAEPARQSSRGSRKAQRKGSNVFSMFSQKQVAEFKEAFQLMDADKDGIISKNDLRATFDQLGRLAVDKELDEMVNEAPGPINFTQLLTLFAGRMSGGSDDDEVVIAAFKTFEDDGKIDSERLRHALMTWGDKFSADEVDDAYDNFEIDDKGFINTAKLIQLLTASPEEEEGGEGEAA

SEQ ID NO: 846 - protein, 356 aa, Blattella germanica (German cockroach)
MVDAAVLEKLEAGFAKLAASDSKSLLRKYLTKEVFDNLKTKKTPTFGSTLLDVIQSGLENHDSGVGIYAPDAEAYTVFADLFDPIIEDYHGGFKKTDKHPPKDWGDVDTLGNLDPAGEYIISTRVRCGRSMQGYPFNPCLTEAQYKEMEDKVSSTLSGLEGELKGQFYPLTGMTKEVQQKLIDDHFLFKEGDRFLQHANACRFWPTGRGIYHNDAKTFLVWCNEEDHLRIISMQMGGDLGQVYRRLVTAVNDIEKRVPFSHDDRLGFLTFCPTNLGTTVRASVRIKVPKLAADKKKLEEVAGKYNLQVRGTRGEHTEAEGGVYDISNKRRMGLTEYDAVKGMNDGIAELIKIESSL

SEQ ID NO: 847 - protein, 515 aa, Blattella germanica (German cockroach)
MKLFPLVALLVLVVGVLSQKDPHVWDGRSAIVHLFEWKFADIADECERFLGPKGFAGVQVSPVHENVIISSPFRPWWERYQLVSYKLVSRSGDENAFRDMVRRCNNVGIRIYVDVVLNQMSGSWPDAHGQGGSTADTYNLQYPAVPYGPGDFHSTCTVSNYQDPSNVRNCELVGLHDLNQGSDYVRGKMIEYLNHLVDCGVAGFRVDAAKHMWPADLQYIYSKVNNLNTDHGFPSGARPFFYQEVIDLGGEAIHSTEYTGFGRVTEFKYSRDIGDAFRGNNAIKWLVNFGVGWGYIPDGDALVFVDNHDNQRGHGAGGASILTYKTSKLYKMAVAFMLAYPYGYPRVMSSFSFDNSDQGPPQDGNGNIISPSINADGTCGNGWVCEHRWRQIFNMVGFRNAVAGTAVSNWWDNGDKQISFCRGNKGFVAFNDEFNNDLKQTLQTCLPAGDYCDVISGSYENGSCTGKTVTVGSDGKAYIEILSSADDGVLAIHVNSKVGSKSQTTTTQSSHCTCS

SEQ ID NO: 848 - protein, 221 aa, Blomia tropicalis (Storage mite)
IPANFDWRQKTHVNPIRNQGGCGSCWAFAASSVAETLYAIHRHQNIILSEQELLDCTYHLYDPTYKCHGCQSGMSPEAFKYMKQKGLLEESHYPYKMKLNQCQANARGTRYHVSSYNSLRYRAGDQEIQAAIMNHGPVVIYIHGTEAHFRNLRKGILRGAGYNDAQIDHAVVLVGWGTQNGIDYWIVRTSWGTQWGDAGYGFVERHHNSLGINNYPIYASL

SEQ ID NO: 849 - protein, 333 aa, Blomia tropicalis (Storage mite)
MKFLLVAALCALVAIGSCKPTREEIKTFEQFKKVFGKVYRNAEEEARREHHFKEQLKWVEEHNGIDGVEYAINEYSDMSEQEFSFHLSGGGLNFTYMKMEAAKEPLINTYGSLPQNFDWRQKARLTRIRQQGSCGSCWAFAAAGVAESLYSIQKQQSIELSEQELVDCTYNRYDSSYQCNGCGSGYSTEAFKYMIRTGLVEEENYPYNMRTQWCNPDVEGQRYHVSGYQQLRYQSSDEDVMYTIQQHGPVVIYMHGSNNYFRNLGNGVLRGVAYNDAYTDHAVILVGWGTVQGVDYWIIRNSWGTGWGNGGYGYVERGHNSLGINNFVTYATL

SEQ ID NO: 850 - protein, 144 aa, Blomia tropicalis (Storage mite)
MFKFICLALLPFWSRAAAGDVKFTDCAHGEVTSLDLSGCSGDHCIIHKGKSFTLKTFFIANQDSEKLEIKISAIMNNIEVPVPGVDKDGCKHTTCPLKKGQKYELDYSLIIPTILPNLKTVTTASLVGDHGVVACGKVNTEVVD

SEQ ID NO: 851 - protein, 142 aa, Blomia tropicalis (Storage mite)
MFKFICLALLVSPAAGGDVKFTACAHGEVTSLDLSGCSGDHCIIHKGKSFTLKTFFIANQDSEKLEIKISAIMNNIEVPVPGVDKDGCKHTTCPLKKGQKYELDYSLIIPTILPNLKTVTTASLVGDHGVVACGKVNTEVVD

SEQ ID NO: 852 - protein, 141 aa, Blomia tropicalis (Storage mite)
MFKFICLALLVSSRRQRCQIYRSCTWEVTSLDLSGCSGDHCIIHKGKSFTLKTFFIANQDSEKLEIKISAIMNNIEVPVPGVDKDGCKHTTCPLKKGQKYELDYSLIIPTILPNLKTVTTASLVGDHGVVACGKVNTEVVD

SEQ ID NO: 853 - protein, 266 aa, Blomia tropicalis (Storage mite)
MKVLVLFCLVSLAAAGPLKDALNKAQVDAFYAEGYIVGGSNAADGDAPYQVSLQRTSHFCGGSIIADNYILTAAHCIQGLSASSLTTRYNTLRHNSGGLTVKASRIIGHEKYDSNTIDNDIALIQTASKMSTGTTNAQAIKLPEQGSDPKASSEVLITGWGTLSSGASSLPTKLQKVTVPIVDRKTCNANYGAVGAEITDNMFCAGILNVGGKDACQGDSGGPVAANGVLVGAVSWGYGCAQAKYPGVYTRVGNYISWIKGKGVPV

SEQ ID NO: 854 - protein, 506 aa, Blomia tropicalis (Storage mite)
MIVELIVFSLALTIPYQTLASSPYSDPHFQHNRKVITHLMQWKFVDIADECERFLGPYGYGGVQVSPVNEHASLDRHPWYELYQPVSYRIVSRSGTESQFRDMVHRCNKAGVRIYVDVVLNHMTGPQSGVGIDGTHYDGNSMQYPGIPFGPNDFHGHESCPTSNLDIQNYDDPTQARNCRLSGLRDLKQSADYVRTKQADFLNHLIDIGVAGFRFDASKHMWPGDLQAIYSKLHHLNEKYFPSNSNPFIYHEVIYSNNNAISISDYTKLGRSIEFHYYHELCNVIRGNNKLKWLHNFGQPWGMVPNDDALIMVDSHDLQRGHTGQLGLNINYFESRLLKVATAFMLAWPYGIPRVMSSYRWNQKIVNGKDENDWIGPPADGSGSILSVKPNSDLTCNQEWICEHRWKQIYNMVQFRNTAGDEPVKNWWDNGDYQIAFSRGAKTFIAINLQNGQHLKQNLHTGLPSGNYCNLVTGNVHNGKCSGQMVHVDGSGHAMISIGANADDHL

SEQ ID NO: 855 - protein, 134 aa, Blomia tropicalis (Storage mite)
MKFAIVLIACFAASVLAQEHKPKKDDFRNEFDHLLIEQANHAIEKGEHQLLYLQHQLDELNENKSKELQEKIIRELDVVCAMIEGAQGALERELKRTDLNILERFNYEEAQTLSKILLKDLKETEQKVKDIQTQ

SEQ ID NO: 856 - protein, 275 aa, Blomia tropicalis (Storage mite)
MNTTTMAFKLVLVLALFCAVHARFPKAIQDRWGYLDTYEYSRNSPRVVGGTDAKKAEAPFQISLMKDYLILKSHICGGSLITPQTVVTAAHCTDGQTASSLINRLGTNQRSKPGIPDIKTKRIVQHEQYDPNTIENDISLLILASPITPSDTVKVIAIEETNLNGGEDVKLYGWGLTDGNTQDLPENLQVGELKIVSQEECNAKWGEVNTIKPGMICALAPSTQACNGDSGGPLVYNGKLAGIVSWGPSKCPVGEYMAVFTRPNHYLEWINANKV

SEQ ID NO: 857 - protein, 195 aa, Blomia tropicalis (Storage mite)
DDAANQLVDQVVDALKTQKGFDPMHVGKHTTELDRKIGLVTFKGKLIIKDATVTGLSRAARVGDAKIHNENGDFVATLELGDSDVKMHSNIELIVGLIQSHLTLDVDIGKLQIMFSAGLAAEGPSVKDFHIDEFEAVRIHVHGLGPLDPFIDIIGDAIITLANSQVREMISTMMRPIIESEVKKFLQNTTPAPAF

SEQ ID NO: 858 - protein, 236 aa, Blomia tropicalis (Storage mite)
MAPLKIGYWDVRGFAEPIRMLLKHLNIEFEETRYGFGNDSEESLPNRDEWLAEKFTLGLEFPNLPYLFDGDFKMTESVAILKRLARANGMIATTEPALSYSEMIEAMIIDIRNRLINVVYAENSGTPEEFEQKLADLRERLETSLGQLEAFFQKHGSQWVAGDKLTYVDFLAYEYLDWYRVFVKSTPIFEKFAKVSDYMKRFEELPSLKEYIARDEHRSASCLSPFARIGHRWAKE

SEQ ID NO: 859 - protein, 284 aa, Blomia tropicalis (Storage mite)
MEAIKKKMQAMKLEKDNAIDRAEIAEQKSRDANLRAEKSEEEVRALQKKIQQIENELDQVQESLTQANTKLEEKEKSLQTAEGDVAALNRRIQLIEEDLERSEERLKVATAKLEEASHSADESERMRKMLEHRSITDEERMDGLESQLKEARMMAEDADRKYDEVARKLAMVEADLERAEERAETGETKIVELEEELRVVGNNLKSLEVSEEKAQQREEAYEQQIRMMTGKLKEAEARAEFAERSVRKLQKEVDRLEDELVHEKEKYKSISDELDQTFAELTGY

SEQ ID NO: 860 - protein, 875 aa, Blomia tropicalis (Storage mite)
MAARSAKYMYQSSRAGHGGDISIEYGTDLGALTRLEDKIRLLSEDLESERELRQRVEREKSDITVQLMNLTERLEETEGSSESVTEMNKKRDSELAKLRKLLEDVHMESEETAHHLRQKHQAAIQEMQDQLDQVQKAKNKSDKEKQKFQAEVFELLAQVETANKDKLVAQKTVEKLEYTVHELNIKIEEINRTVVEVTAHRQRLSQENSELIKEVHEYKISLDNANHLKGQIAQQLEDTRHRLEDEERKRSSLENHAHTLEVELESLKVQLEEESEARLELERQLTKANGDAASWKSKYEAELQAHVDEVEELRRKMAQKISEYGEQLEALLNKCSALEKQKARLQSEVEVLIMDLEKATAHAQALEKRVSQLEKINLDLKSKLEEVSMLLEQTQKDLRVKIADLQKLQHEYEKLRDQKEALARENKKLADDLAEAKSQLNDAHRRIHEQEIEIKRLENEREELAAAYKEAETLRKQEEAKNQRLTAELAQTRHDYEKRLAQKEEEIEALRKQYQIEIEQLNMRLAEAEAKLKTEVARLKKKYQAQITELELSLDAANKANIDLQKTIKKQALQITGLQAHYDEVHRQLQQAVDQLGVTQRRCQALTAELEEMRVNLEQALRAKRAAEQMHEEAVVRVNELTTINVNLASAKSKLETEFSALQNDYDEVHKELRISDERVQKLTIEVKSTKDLLESETERVTKLETIKKSLETEVRNLQIRIEEVEANALAGGKRVIAKLESRIRDVEIEVEEERRRHAETEKMLRKKDHRVKELLLQNEEDHKQIQLLQEMSDKLNEKVKVYKRQMQEQEGMSQQNLTRVRRFQRELEAAEDRADQAESNLSFIRAKHRSWVTTSQVPGGTRQVFVTEQESSNF

SEQ ID NO: 861 - protein, 144 aa, Blomia tropicalis (Storage mite)
MKSVLIFLVAIALFSANIVSADEQTTRGRHTEPDDHHEKPTTQCTHEETTSTQHHHEEVVTTQTPHHEEKTTTEETHHSDDLIVHEGGKTYHVVCHEEGPIHIQEMCNKYIICSKSGSLWYITVMPCSIGTKFDPISRNCVLDN

SEQ ID NO: 862 - protein, 130 aa, Blomia tropicalis (Storage mite)
MPIEGKYKLEKSDNFDKFLDELGVGFMVKTAAKTLKPTLEVDVQGDTYVFRSLSTFKNTEIKFKLGEEFEEDRADGKRVKTVVNKEGDNKFIQTQYGDKEVKIVRDFQGDDVVVTASVGDVTSVRTYKRI

SEQ ID NO: 863 - protein, 70 aa, Blomia tropicalis (Storage mite)
HPAQALDFTSCARMNDGALGAKVAQAACISSCKFQNCGTGHCERRGGRPTCVCSRCGNGGGEWPNLPSRG

SEQ ID NO: 864 - protein, 129 aa, Blomia tropicalis (Storage mite)
MKFIIALAALIAVACALPVSNDNFRHEFDHMIVNTATQRFHEIEKFLLHITHEVDDLEKTGNKDEKARLLRELTVSEAFIEGSRGYFQRELKRTDLDLLEKFNFEAALATGDLLLKDLKALQKRVQDSE

SEQ ID NO: 865 - protein, 136 aa, Bombus pennsylvanicus (Bumble bee)
IIYPGTLWCGNGNIANGTNELGLWKETDACCRTHDMCPDIIEAHGSKHGLTNPADYTRLNCECDEEFRHCLHNSGDAVSAAFVGRTYFTILGTQCFRLDYPIVKCKVKSTILRECKEYEFDTNAPQKYQWFDVLSY

SEQ ID NO: 866 - protein, 243 aa, Bombus pennsylvanicus (Bumble bee)
VVGGKPAKLGAWPWMVALGFHNYRQPKKSPEWKCGGSLRISRHVLTAAHCAIHRSLYVVRIADLNLKRDDDGAHPIQMGIESKLIHPDYVYSEHHDDIAILKLEKDVSFSEYIRPICLPIEESLRNNNFIGYNPFVAGWGRLRYKGPLSDALMEVQVPVVRNKVCKRAYSDVSDTVICAGYPKGRKDSCQGDSGGPLMIPQESTYYEIGVVSYGHECALPKYPGVYTRVTSYLDSFILPALKK

SEQ ID NO: 867 - protein, 136 aa, Bombus terrestris (Bumble bee)
IIFPGTLWCGNGNLANGTNQLGSWKETDSCCRTHDMCPDLIEAHGSKHGLTNAADYTRLSCECDEEFRRCLHNSGDTVSAGFVGRTYFTVLHTQCFRLDYPIVKCKVKSTILHRSKCYDFETFAPKKYQWFDVLQY

SEQ ID NO: 868 - protein, 20 aa, Bombus terrestris (Bumble bee)
VVGGKPAKLGAWPWMVALGF

SEQ ID NO: 869 - protein, 355 aa, Bombyx mori (Silk moth)
MVDAATLEKLEAGFSKLQGSDSKSLLKKYLTREVFDSLKNKKTSFGSTLLDCIQSGVENLDSGVGIYAPDAESYSVFAELFDPIIEDYHNGFKKTDKHPPKNWGDVDTLGNLDPAGEFVVSTRVRCGRSLEGYPFNPCLTESQYKEMEDKVSGTLSSLEGELKGTFYPLTGMSKETQQQLIDDHFLFKEGDRFLQAANACRFWPTGRGIYHNENKTFLVWCNEEDHLRIISMQMGGDLQQVYKRLVSAVNEIEKKIPFSHHDRLGFLTFCPTNLGTTVRASVHIKLPKLAADKKKLEEVASKYHLQVRGTRGEHTEAEGGVYDISNKRRMGLTEYDAVKEMYDGIAELIKIEKSL

SEQ ID NO: 870 - protein, 264 aa, Charybdis feriatus (Crab)
MDAIKKKMQAMKLEKDNAMDRADTLEQQNKEANLRAEKTEEEIRATQKKMQQVENELDQAQEQLSAANTKLDEKEKALQNAEGEVAALNRRIQLPEEDLERSEERLNTATTKLAEASQAADESERMRKVLENRSLSDEERMDALENQLKEARFLAEEADRKYDEVARKLAMVEADLERAEERAESGESKIVELEEELRVVGNNLKSLEVSEEKANQREETYKEQIKTLANKLKAAEARAEFAERSVQKLQKEVDRLEDELVNEK

SEQ ID NO: 871 - protein, 285 aa, Chironomus kiiensis (Midge)
MDAIKKKMQAMKLEKDNALDRALLCENQARDANLRAEKAEEEARTLQKKIQTIENDLDQTQGQETLVNGKLEGKEKALQNAESEVAALNRRIQLLGEDLDRSEERLASATAKLSEASAAADESERARKILENRSLADEERMDALENQLKEARFLAEEADKKYDEVARKLAMVEADLERAEERAEAGEAKIVELEEELRVVGNNLKSLEVSEEKANQREEEYKNQIKTLTTRLKEAEARAEFAERSVQKLQKEVDRLEDELVSEKEKYREIGDDLDTAFVELILKE

SEQ ID NO: 872 - protein, 151 aa, Chironomus thummi thummi (Midge)
MKFLILALCFAAASALSADQISTVQASFDKVKGDPVGILYAVFKADPSIMAKFTQFAGKDLESIKGTAPFEIHANRIVGFFSKIIGELPNIEADVNTFVASHKPRGVTHDQLNNFRAGFVSYMKAHTDFAGAEAAWGATLDTFFGMIFSKM

SEQ ID NO: 873 - protein, 151 aa, Chironomus thummi thummi (Midge)
MKLLILALCFAAASALTADQISTVQSSFAGVKGDAVGILYAVFKADPSIQAKFTQFAGKDLDSIKGSADFSAHANKIVGFFSKIIGDLPNIDGDVTTFVASHTPRGVTHDQLNNFRAGFVSYMKAHTDFAGAEAAWGATLDAFFGMVFAKM

SEQ ID NO: 874 - protein, 158 aa, Chironomus thummi thummi (Midge)
MKFLILALCVAAAMAGPSGDQIAAAKASWNTVKNNQVDILYAVFKANPDIQTAFSQFAGKDLDSIKGTPDFSKHAGRVVGLFSEVMDLLGNDANTPTILAKAKDFGKSHKSRASPAQLDNFRKSLVVYLKGATKWDSAVESSWAPVLDFVFSTLKNEL

SEQ ID NO: 875 - protein, 160 aa, Chironomus thummi thummi (Midge)
MKFLVLALCIAAAVAAPLSADEASLVRGSWAQVKHSEVDILYYIFKANPDIMAKFPQFAGKDLETLKGTGQFATHAGRIVGFVSEIVALMGNSANMPAMETLIKDMAANHKARGIPKAQFNEFRASLVSYLQSKVSWNDSLGAAWTQGLDNVFNMMFSYL

SEQ ID NO: 876 - protein, 162 aa, Chironomus thummi thummi (Midge)
MKFLVLALCIAAASAAVLTTEQADLVKKTWSTVKFNEVDILYAVFKAYPDIMAKFPQFAGKDLDSIKDSAAFATHATRIVSFLSEVISLAGSDANIPAIQNLAKELATSHKPRGVSKDQFTEFRTALFTYLKAHINFDGPTETAWTLALDTTYAMLFSAMDS

SEQ ID NO: 877 - protein, 161 aa, Chironomus thummi thummi (Midge)
MKFFAVLALCIVGAIASPLSADQAALVKSTWAQVRNSEVEILAAVFTAYPDIQARFPQFAGKDVASIKDTGAFATHAGRIVGFVSEIIALIGNESNAPAVQTLVGQLAASHKARGISQAQFNEFRAGLVSYVSSNVAWNAAAESAWTAGLDNIFGLLFAAL

SEQ ID NO: 878 - protein, 161 aa, Chironomus thummi thummi (Midge)
MKFFIVLALCIVGAIADPVSSDQANAIRASWAGVKHNEVDILAAVFSDHPDIQARFPQFAGKDLASIKDTGAFATHAGRIVGFISEIVALVGNESNAPAMATLINELSTSHHNRGITKGQFNEFRSSLVSYLSSHASWNDATADAWTHGLDNIFGMIFAHL

SEQ ID NO: 879 - protein, 161 aa, Chironomus thummi thummi (Midge)
MKFFAVLALCIVGAIASPLTADEASLVQSSWKAVSHNEVDILAAVFAAYPDIQAKFPQFAGKDLASIKDTGAFATHATRIVSFLSEVIALSGNESNASAVNSLVSKLGDDHKARGVSAAQFGEFRTALVAYLSNHVSWGDNVAAAWNKALDNTYAIVVPRL

SEQ ID NO: 880 - protein, 161 aa, Chironomus thummi thummi (Midge)
MKFFAVLALCIVGAIASPLTADEASLVQSSWKAVSHNEVDILAAVFAAYPDIQAKFPQFAGKDLASIKDTGAFATHATRIVSFLSEVIALSGNASNAAAVEGLLNKLGSDHKARGVSAAQFGEFRTALVSYLSNHVSWGDNVAAAWNKALDNTMAVAVAHL

SEQ ID NO: 881 - protein, 161 aa, Chironomus thummi thummi (Midge)
MKFFAVLALCIVGAIASPLTADEASLVQSSWKAVSHNEVEILAAVFAAYPDIQNKFSQFAGKDLASIKDTGAFATHATRIVSFLSEVIALSGNTSNAAAVNSLVSKLGDDHKARGVSAAQFGEFRTALVAYLQANVSWGDNVAAAWNKALDNTFAIVVPRL

SEQ ID NO: 882 - protein, 161 aa, Chironomus thummi thummi (Midge)
MKFFAVLALCIVGAIASPLTADEASLVQSSWKAVSHNEVEILAAVFAAYPDIQNKFSQFAGKDLASIKDTGAFATHATRIVSFLSEVIALSGNDSNAAAVNSLVSKLGDDHKARGVSAAQFGEFRTALVAYLQANVSWGDNVAAAWNKALDNTFAIVVPRL

SEQ ID NO: 883 - protein, 162 aa, Chironomus thummi thummi (Midge)
MKFFAVLALCVVGAIASPLSADEAAIVKSSWDQVKHNEVDILAAVFAAYPDIQAKFPQFAGKDLASIKDTAAFATHATRIVSFFTEVISLSGNQANLSAVYALVSKLGVDHKARGISAAQFGEFRTALVSYLQAHVSWGDNVAAAWNHALDNTYAVALKSLE

SEQ ID NO: 884 - protein, 151 aa, Chironomus thummi thummi (Midge)
AVTPMSADQLALFKSSWNTVKHNEVDILYAVFKANPDIQAKFPQFAGKDLDSIKDSADFAVHSGRIVGFFSEVIGLIGNPENRPALKTLIDGLASSHKARGIEKAQFEEFRASLVDYLSHHLDWNDTMKSTWDLALNNMFFYILHALEVAQ

SEQ ID NO: 885 - protein, 151 aa, Chironomus thummi thummi (Midge)
VATPAMPSMTDAQVAAVKGDWEKIKGSGVEILYFFLNKFPGNFPMFKKLGNDLAAAKGTAEFKDQADKIIAFLQGVIEKLGSDMGGAKALLNQLGTSHKAMGITKDQFDQFRQALTELLGNLGFGGNIGAWNATVDLMFHVIFNALDGTPV

SEQ ID NO: 886 - protein, 151 aa, Chironomus thummi thummi (Midge)
DPEWHTLDAHEVEQVQATWKAVSHDEVEILYTVFKAHPDIMAKFPKFAGKDLEAIKDTADFAVHASRIIGFFGEYVTLLGSSGNQAAIRTLLHDLGVFHKTRGITKAQFGEFRETMTAYLKGHNKWNADISHSWDDAFDKAFSVIFEVLES

SEQ ID NO: 887 - protein, 284 aa, Chortoglyphus arcuatus (Storage mite)
MEAIKKKMQAMKLEKDNAIDRAEIAEQKSRDANLKAEKSEEEVRGLQKKIQQIENELDQVQESFTQANTKLEEKEKALQTAEGDVAALNRRIQLIEEDLERSEERLKVATAKLEEASHAADESERMRKMLEHRSITDEERMDGLENQLKEARMMAEDADRKYDEVARKLAMVEADLERAEERAETGESKIVELEEELRVVGNNLKSLEVSEEKAQQREEAYEQQIRIMTAKLKEAEARAEFAERSVQKLQKEVDRLEDELVHEKEKYKSISDELDQTFAELTGY

SEQ ID NO: 888 - protein, 284 aa, Crangon crangon (North Sea shrimp)
MDAIKKKMQAMKLEKDNAMDRADTLEQQNKEANNRAEKSEEEVFSLQKRMQQLENDLDSVQEALLKANAHLEEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 889 - protein, 356 aa, Crangon crangon (North Sea shrimp)
MVDAEVLEKLEAGYKKLEAATDCKSLLKKYLTKEVFDELKTKKTALGATLLDVIQSGVENLDSGVGIYAPDAEAYTLFAPLFDPIIEDYHVGFKQSDKHPGKDFGDLEKFVNVDPEGTFVVSTRVRCGRSMEGYPFNPCLTEAQYKEMESKVSSTLSSLEGELKGTYYPLTGMSKDVQQKLIDDHFLFKEGDRFLQAANACRYWPAGRGIYHNDNKTFLVWVNEEDHLRIISMQMGGDLGQVFRRLTSAVNEIEKRIPFSHHDRLGFLTFCPTNLGTTVRASVHIKLPKLAANRDKLESVAGKYNLQVRGTRGEHTEAEGGIYDISNKRRMGLTEFQAVKEMQDGILEPIKMEKEM

SEQ ID NO: 890 - protein, 193 aa, Crangon crangon (North Sea shrimp)
MAYTWDNRVKYVVRYMYDIDNNGFLDKNDFECLAVKNTLIECRGEWSAEKYAANQKIMSNLWNEIAELADFNKDGEVTVEEFKQAVQKHCNGKPFGDFPSAFKTFIANQFKTIDVNGDGLVGVDEYRLDCISRSAFSCIKEIDDAYNLLCTEEDKKAGGINIARYQELYAQFISNPDEKCNAVYLFGPLKEVV

SEQ ID NO: 891 - protein, 153 aa, Crangon crangon (North Sea shrimp)
MAADLSARDVERVKFAFSIYDFEGNGQIDAFYIGDCLRALNLNPTLALIAKLGGTEKRKEKMIKLDDFMPLFAQVKKDKDAGSYEDFIEVLKLYDKAENGTMMYAELEHILLSLGERLDKAELEPILRECCPPEDDEGLIPFEPFVKKLTQLL

SEQ ID NO: 892 - protein, 150 aa, Crangon crangon (North Sea shrimp)
MDSLEPDQIDALKKAFDSFDTENQGFITADTVATILRMMGVKISDKNLAEVIAETDEDGSGQLEFEEFVDLSSKFLIEEDEEALKAELREAFRIYDKEGQGFITTDVLKEILTEIDNKLTPEDLDGIIEEVDEDGSGTLDFDEFMEMMSG

SEQ ID NO: 893 - protein, 249 aa, Crangon crangon (North Sea shrimp)
MSGSRKFFVGGNWKMNGDKAAIDGIVDFMKKGPLNPNTEVVVGCPQCYLSYTREKLPAEIGVAAQNCYKVAKGAFTGEISPAMVKDCGCEWVILGHSERRNVFNEPDQLISEKVGHALEAGLKVIPCIGEKLDERESNRTEEVVFAQMKALVPNISDWSRVVIAYEPVWAIGTGKTASPEQAQDVHAKLRQWLTENVSAEVAESCRIIYGGSVSPSNCAELAKMGDIDGFLVGGASLKPDFVTIINARG

SEQ ID NO: 894 - protein, 176 aa, Ctenocephalides felis (Cat flea)
MNYCFLVFLVYLVFAVNGEDIWKVNKKCTSGGKNQDRKLDQIIQKGQQVKIQNICKLIRDKPHTNQEKEKCMKFCKKVCKGYRGACDGNICYCSRPSNLGPDWKVSKECKDPNNKDSRPTEIVPYRQQLAIPNICKLKNSETNEDSKCKKHCKEKCRGGNDAGCDGNFCYCRPKNK

SEQ ID NO: 895 - protein, 264 aa, Ctenocephalides felis (Cat flea)
MNSLLSSIIIVVFSVWLSVIFAVNVKPKPNQDDYCNLNCTNGPNVGCTKPDVPRDCQNFKLVNITERMKKAFLNAHNRKRRLVAAGKGLLKDGVHTPIAAKMPNLTWNIALAKLAEYNVKQCEMKHDCAKTRHGHTGQNLFFYGTTLSPIKNSTIAKMAVDGWYAESKDTRLEDIKKLTTIYPNGKPIGHYTQLIWGNTTKVGCAVSTYKKHSNGNMFNMTLVACNYRGGNMLEEAVYQIKDAKNPKSKNQTKNNKKPKQKMPK

SEQ ID NO: 896 - protein, 321 aa, Dermatophagoides farinae (American house dust mite)
MKFVLAIASLLVLSTVYARPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTVTPIRMQGGCGSCWAFSGVAATESAYLAYRNTSLDLSEQELVDCASQHGCHGDTIPRGIEYIQQNGVVEERSYPYVAREQQCRRPNSQHYGISNYCQIYPPDVKQIREALTQTHTAIAVIIGIKDLRAFQHYDGRTIIQHDNGYQPNYHAVNIVGYGSTQGVDYWIVRNSWDTTWGDSGYGYFQAGNNLMMIEQYPYVVIM

SEQ ID NO: 897 - protein, 276 aa, Dermatophagoides farinae (American house dust mite)
RPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTVTPIRMQGGCGSCWAFSGVAATESAYLAYRNTSLDLSEQELVDCASQHGCHGDTIPRGIEYIQQNGVVEERSYPYVAREQQCRRPNSQHYGISNYCQIYPPDVKQIREALTQTHTAIAVIIGIKDLRAFQHYDGRTIIQRDNGYQPNYHAVNIVGYGSTQGVDYWIVRNSWDTT

SEQ ID NO: 898 - protein, 321 aa, Dermatophagoides farinae (American house dust mite)
MKFVLAIASLLVLSTVYARPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTVTPIRMQGGCGSCWAFSGVAATESAYLAYRNTSLDLSEQELVDCASQHGCHGDTIPRGIEYIQQNGVVEERSYPYVAREQRCRRPNSQHYGISNYCQIYPPDVKQIREALTQTHTAIAVIIGIKDLRAFQHYDGRTIIQHDNGYQPNYHAVNIVGYGSTQGDDYWIVRNSWDTTWGDSGYGYFQAGNNLMMIEQYPYVVIM

SEQ ID NO: 899 - protein, 321 aa, Dermatophagoides farinae (American house dust mite)
MKFVLAIASLLVLSTVYARPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTATPIRMQGGCGSCWAFSGVAATESAYLAYRNTSLDLSEQELVDCASQHGCHGDTIPRGIEYIQQNGVVEERSYPYVAREQQCRRPNSQHYGISNYCQIYPPDVKQIREALTQTHTAIAVIIGIKDLRAFQHYDGRTIIQHDNGYQPNYHAVNIVGYGSTQGVDYWIVRNSWDTTWGDSGYGYFQAGNNLMMIEQYPYVVIM

SEQ ID NO: 900 - protein, 321 aa, Dermatophagoides farinae (American house dust mite)
MKFVLAIASLLVLSTVYARPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTVTPIRMQGGCGSCWAFSGVAATESAYLAYRNTSLDLSEQKLVDCASQHGCHGDTIPRGIEYIQQNGVVEERSYPYVAREQQCRRPNSQHYGISNYCQIYPPDVKQIREALTQTHTAIAVIIGIKDLRAFQHYDGRTIIQHDNGYQPNYHAVNIVGYGSTQGVDYWIVRNSWDTTWGDSGYGYFQAGNNLMMIEQYPYVVIM

SEQ ID NO: 901 - protein, 321 aa, Dermatophagoides farinae (American house dust mite)
MKFVLAIASLLVLSTVYARPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTVTPIRMQGGCGSCWAFSGVAATESAYLAYRNTSLDLSEQELVDCASQHGCHGDTIPRGIEYIQQNGVVEERSYPYVAREQQCRRPNSQHYGISNYCQIYPPDVKQIREALTQTHTAIAVIIGIKDLRAFQHYDGRTIIRHDNGYQPNYHAVNIVGYGSTQGVDYWIVRNSWDTTWGDSGYGYFQAGNNLMMIEQYPYVVIM

SEQ ID NO: 902 - protein, 146 aa, Dermatophagoides farinae (American house dust mite)
MISKILCLSLLVAAVVADQVDVKDCANNEIKKVMVDGCHGSDPCIIHRGKPFTLEALFDANQNTKTAKIEIKASLDGLEIDVPGIDTNACHFMKCPLVKGQQYDIKYTWNVPKIAPKSENVVVTVKLIGDNGVLACAIATHGKIRD

SEQ ID NO: 903 - protein, 146 aa, Dermatophagoides farinae (American house dust mite); identical to SEQ ID NO: 902

SEQ ID NO: 904 - protein, 129 aa, Dermatophagoides farinae (American house dust mite)
DQVDVKDCANNEIKKVMVDGCHGSDPCIIHRGKPFTLEALFDANQNTKTAKIEIKASLDGLEIDVPGIDTNACHFMKCPLVKGQQYDAKYTWNVPKIAPESENVVVTVKLVGDNGVLACAIATHAKIRD

SEQ ID NO: 905 - protein, 146 aa, Dermatophagoides farinae (American house dust mite)
MISKILCLSLLVAAVVADQVDVKDCANHEIKKVMVDGCHGSDPCIIHRGKPFNLEAIFDANQNTKTAKIEIKANIDGLEVDVPGIDTNACHYIKCPLVKGQQYDAKYTWNVPKIAPKSENVVVTVKLVGDNGVLACAIATHAKIRD

SEQ ID NO: 906 - protein, 146 aa, Dermatophagoides farinae (American house dust mite)
MISKILCLSLLVAAVVADQVDVKDCANNEIKKVMVDGCHGSDPCIIHRGKPFTLEALFDANQNTKTAKIEIKANINGLEVDVPGIDTNACHYIKCPLVKGQQYDAKYTWNVPKIAPKSENVVVTVKLIGDNGVLACAIATHAKIRD

SEQ ID NO: 907 - protein, 146 aa, Dermatophagoides farinae (American house dust mite)
MISKILCLSLLVAAVVADQVDVKDCANNEIKKVMVDGCHGSDPCIIHRGKPFTLEALFDANQNTKTAKIEIKANIDGLEVDVPGIDTNACHYIKCPLVKGQQYDAKYTWNVPKIAPKSENVVVTVKLVGDNGVLACAIATHAKIRD

SEQ ID NO: 908 - protein, 129 aa, Dermatophagoides farinae (American house dust mite)
DQVDVKDCANNEIKKVMVDGRHGSDPCIIHRGKPFTLEALFDANQNTKTAKIEIKANINGLEVDVPGIDTNACHFVKCPLVKGQQYDIKYTWNVPKIAPKSENVVVTVKLIGDNGVLACAIATHAKIRD

SEQ ID NO: 909 - protein, 140 aa, Dermatophagoides farinae (American house dust mite)
MVSLLVAAVVADQVDVKDCANNEIKKVMVDGCHGSDPCIIHRGKPFTLEALFDANQNTKTAKIEIKASLDGLEIDVPGIDTNACHFMKCPLVKGQQYDAKYTWNVPKIAPKSENVVVTVKLVGDNGVLACAIATHGKIRD

SEQ ID NO: 910 - protein, 146 aa, Dermatophagoides farinae (American house dust mite)
MISKILCLSLLVAAVVADQVDVKDCANNEIKKVMVDGCHGSDPCIIHRGKPFTLEALFDANQNTKTAKIEIKANINGLEVDVPGIDTNACHYIKCPLVKGQQYDAKYTWNVPKIAPKSENVVVTVKLIGDNGVLACAIATHGKIRD

SEQ ID NO: 911 - protein, 259 aa, Dermatophagoides farinae (American house dust mite)
MMILTIVVLLAANILATPILPSSPNATIVGGVKAQAGDCPYQISLQSSSHFCGGSILDEYWILTAAHCVNGQSAKKLSIRYNTLKHASGGEKIQVAEIYQHENYDSMTIDNDVALIKLKTPMTLDQTNAKPVPLPAQGSDVKVGDKIRVSGWGYLQEGSYSLPSELQRVDIDVVSREQCDQLYSKAGADVSENMICGGDVANGGVDSCQGDSGGPVVDVATKQIVGIVSWGYGCARKGYPGVYTRVGNFVDWIESKRSQ

SEQ ID NO: 912 - protein, 525 aa, Dermatophagoides farinae (American house dust mite)
MLPKFFFILITVLTLLVSLFVNGDSKFSNPHFIGNRSVITHLMEWKYDDIGDECERFLGPYGYGGVQVSPVNEHAIMDGRPWYERYQPVSYDIHTRSGDEQQFRRMVQRCNKAGVRIYVDIVLNHMTGGQSGLGTNGHHYDGVAMQYPGVPFGPNDFHGHETCPTNDLEIHNYSNRIEARNCRLVGLRDLKQQSEYVKQKQVDFLNHLIDIGVAGFRSDASTHQWPDDLRSIYSRLHNLNNEFFTENSHPFIYHETIYYGGNGINSNEYTSLGRIIEFRFYKEITNVFRNNNQLRWLRNFGTEWGLVPSGDALVMIDSHDLRVGHTGQLGFNINCFEARLLKAATAFMLAWNYGIPRVMSSYFWDQIIRDGKDVNDWVGPPTDQHGNILSVHPNPDMTCNHEWICEHRWREIYNMVKFKLIAGQEPVNNWWDNGDNQIAFSRGNRAFIAINLQKNGNDHDKNLQKRLQTGLPPGIYCDIISGNLINNRCMGKSIQVDKNGLSDIYVGHDEFDAFVAYHIDARVES

SEQ ID NO: 913 - protein, 279 aa, Dermatophagoides farinae (American house dust mite)
MIKIFLVTILIVITVTVDARFPRSLQPKWAYLDSNEFPRSKIGDSPIAGVVGGQDADLAEAPFQISLLKDYLIMKRHMCGGSLISESTVVTAAHCTYGQKASSLSVRYGTNQRTSSSYGDLKVKPIIQHESYEQDQTQTDKTIIILPNPVVPSTNVQMNEIETEDIVDGDKVTIYGWGLTDGNGKDLPDKLQKGSMTIVGNDRCNEKWGSINAIHPGMICALDKTQSGCNGDSGGPLVSANRKLTGIVSWGPSKCPPGEYMSVFTRPKYYLDWITKNIV

SEQ ID NO: 914 - protein, 213 aa, Dermatophagoides farinae (American house dust mite)
MMKFLLIAAVAFVAVSADPIHYDKITEEINKAIDDAIAAIEQSETIDPMKVPDHADKFERHVGIVDFKGELAMRNIEARGLKQMKRQGDANVKGEEGIVKAHLLIGVHDDIVSMEYDLAYKLGDLHPTTHVISDIQDFVVALSLEISDEGNITMTSFEVRQFANVVNHIGGLSILDPIFGVLSDVLTAIFQDTVRKEMTKVLAPAFKRELEKN

SEQ ID NO: 915 - protein, 197 aa, Dermatophagoides farinae (American house dust mite)
MLAYAGVDYVDKRYNIGPNFDRSEWLNEKFNLGLDFPNLPYYMDGDVKITQSMAILRYLARKYNMDGTNEQERLRISMAEQQTHDMFMAMVRICYDPNMENLRVDYLKTLPDSLKLMEKFLANHDYIAGSKISYADFYLYEYLCRMKVMVPEVYGQFENLKKFVERIESLPRIAEYIKKQKPTTFNASLAKWNGSYA

SEQ ID NO: 916 - protein, 284 aa, Dermatophagoides farinae (American house dust mite)
MEAIKKKMQAMKLEKDNAIDRAEIAEQKARDANLRAEKSEEEVRALQKKIQQIENELDQVQEQLSAANTKLEEKEKALQTAEGDVAALNRRIQLIEEDLERSEERLKIATAKLEEASQSADESERMRKMLEHRSITDEERMDGLENQLKEARMMAEDADRKYDEVARKLAMVEADLERAEERAETGESKIVELEEELRVVGNNLKSLEVSEEKAQQREEAYEQQIRIMTAKLKEAEARAEFAERSVQKLQKEVDRLEDELVHEKEKYKSISDELDQTFAELTGY

SEQ ID NO: 917 - protein, 692 aa, Dermatophagoides farinae (American house dust mite)
MNKKRDSELAKLRKLLEDVHIESEETAHHLRQKHQAAIQEMQDQLDQLQKAKNKSDKEKQKFQAEVFELLAQLETANKEKLTALKNVEKLEYTVHELNIKIEEINRTVIELTSHKQRLSQENTELIKEVHEVKLQLDNANHLKTQIAQQLEDTRHRLEEEERKRASLENHAHTLEVELESLKVQLDEESEARLELERQLTKANGDAASWKSKYEAELQAHADEVEELRRKMAQKISEYEEQLEALLNKCSSLEKQKSRLQSEVEVLIMDLEKATRHAQQLEKRVAQLEKINLDLKNKLEEVTMLMEQAQKELRVKIAELQKLQHEYEKLRDQRDQLARENKKLTDDLAEAKSQLNDAHRRIHEQEIEIKRLENERDELSAAYKEAETLRKQEEAKNQRLIAELAQVRHDYEKRLAQKDEEIEALRKQYQIEIEQLNMRLAEAEAKLKTEIARLKKKYQAQITELELSLDAANKANIDLQKTIKKQALQITELQAHYDEVHRQLQQAVDQLGVTQRRCQALQAELEEMRIALEQANRAKRQAEQLHEEAVVRVNELTTINVNLASAKSKLESEFSALQADYDEVHKELRISDERVQKLTIELKSTKDLLIEEQERLVKLETVKKSLEQEVRTLHVRIEEVEANALAGGKRVIAKLESRIRDVEIEVEEERRRHAETDKMLRKKDHRVKELLLQ

SEQ ID NO: 918 - protein, 131 aa, Dermatophagoides farinae (American house dust mite)
MASIEGKYKLEKSEKFDEFLDKLGVGFMVKTAAKTLKPTFEVAIENDQYIFRSLSTFKNTEAKFKLGEEFEEDRADGKRVKTVIQKEGDNKFVQTQFGDKEVKIIREFNGDEVVVTASCDGVTSVRTYKRI

SEQ ID NO: 919 - protein, 349 aa, Dermatophagoides farinae (American house dust mite)
VTALELLLKGETEDKTRRYVAELTAVGSPSNKQAKAQIEVTKGEEYKITLKSPEHEFNTEFTIHADKNNLKMHMDFPNVFQADLTGTFQHDKENNVRKNQLNLQYKFAGDEKPHTVDYENEFSFNLKRSSKDKNSGVDYRAKYMSSHFPILNHKVNIQFKYRPFKVNELNLEGEFGRELQHKFQLMRNSQIEVEEVRPFKMHGNSDIKLMANDLDIDYDLKSEFKYESNKGTPIELQYKISGKDRSKRAADLGAEDVEGVIDYKNNGSPIDSKMHAHLKMKGNNYGYDSELKQTQPQQYEGKITLSKNDKKIFINHKSEMTKPTNTFHLKTDADVSYSDSDMKKHYQME

SEQ ID NO: 920 - protein, 555 aa, Dermatophagoides farinae (American house dust mite)
MKTIYAILSIMACIGLMNASIKRDHNDYSKNPMRIVCYVGTWSVYHKVDPYTIEDIDPFKCTHLMYGFAKIDEYKYTIQVFDPYQDDNHNSWEKRGYERFNNLRLKNPELTTMISLGGWYEGSEKYSDMAANPTYRQQFIQSVLDFLQEYKFDGLDLDWEYPGSRLGNPKIDKQNYLALVRELKDAFEPHGYLLTAAVSPGKDKIDRAYDIKELNKLFDWMNVMTYDYHGGWENFYGHNAPLYKRPDETDELHTYFNVNYTMHYYLNNGATRDKLVMGVPFYGRAWSIEDRSKLKLGDPAKGMSPPGFISGEEGVLSYIELCQLFQKEEWHIQYDEYYNAPYGYNDKIWVGYDDLASISCKLAFLKELGVSGVMVWSLENDDFKGHCGPKNPLLNKVHNMINGDEKNSFECILGPSTTTPTPTTTPTTPTTTPTTPSPTTPTTTPSPTTPTTTPSPTTPTTTPSPTTPTPTTPTPAPTTSTPSPTTTEHTSETPKYTTYVDGHLIKCYKEGDIPHPTNIHKYLVCEFVNGGWWVHIMPCPPGTIWCQEKLTCIGE

SEQ ID NO: 921 - protein, 480 aa, Dermatophagoides farinae (American house dust mite)
MAAHDKNFDVIPIGHTFFFIWRIKQFELVPVPKEDYGKFYKGDCYIVACCTENPTGGHSKMESKPILNGHGYCHIHFWIGSESTKDEAGVAAIKSVELDDFLGGYPVQHREIEEFESRQFSSYFKNGIIYLKGGYESGFTKMIDELKPSLLHVKGKKRPIVYECAEISWKVMNNGDVFILLVPNFVFVWTGKHSNRMERTTAIRVANDLKSELNRFKLSSVILEDGKEVEQTSGAEYDAFNKALSLDKKDIDLKQMPKGYDYAASDKSFESHERSFVTLYKCFEGTETIDISFVKNGPLSRADLDTNDTFIVENGSEGLWVWVGKKATQKERQSAIKYAMELINKKKYPNNTPVTKVLEGDESVEFKSLFESWQMSEQEKITSARLFRVSRNGIFKQVANYEPDDLEEDNIMILDVMDKIYVWIGNQFAERIADEAHVDKVAQRFIQEDKSGRKFQPNQIIKLKQGSEDGAFKSYFPKWN

SEQ ID NO: 922 - protein, 462 aa, Dermatophagoides farinae (American house dust mite)
MTRFSLTVLAVLAACFGSNIRPNVATLEPKTVCYYESWVHWRQGEGKMDPEDIDTSLCTHIVYSYFGIDAATHEIKLLDEYLMKDLHDMEHFTQHKGNAKAMIAVGGSTMSDQFSKTAAVEHYRETFVVSTVDLMTRYGFDGVMIDWSGMQAKDSDNFIKLLDKFDEKFAHTSFVMGVTLPATIASYDNYNIPAISNYVDFMNVLSLDYTGSWAHTVGHASPFPEQLKTLEAYHKRGAPRHKMVMAVPFYARTWILEKMNKQDIGDKASGPGPRGQFTQTDGFLSYNELCVQIQAETNAFTITRDHDNTAIYAVYVHSNHAEWISFEDRHTLGEKAKNITQQGYAGMSVYTLSNEDVHGVCGDKNPLLHAIQSNYYHGVVTEPTVVTLPPVTHTTEHVTDIPGVFHCHEEGFFRDKTYCATYYECKKGDFGLEKTVHHCANHLQAFDEVSRTCIDHTKIPGC

SEQ ID NO: 923 - protein, 356 aa, Dermatophagoides farinae (American house dust mite)
MVDQAVIDKLEAGFQKLQSSAECHSLLKKYLTRNVLDACKGRKTGMGATLVDVVQSGFENLDSGVGLYAPDAESYTLFKELFDPVIEDYHKGFKPTDKHPQTDFGDVNTLCNVDPNNEFVISTRVRCGRSLQGYPFNPCLTEAQYKEMEEKVKGQLNSFEGELKGTYYPLLGMDKATQQQLIDDHFLFKEGDRFLQAANACRFWPVGCGIFHNDNKTFLIWVNEEDHLRIISMQKGGDLKQVFSRLINGVNHIEKKLPFSRDDRLGFLTFCPTNLGTTIRASVHIKLPKLAADRKKLEEVAGKYNLQVRGTAGEHTESVGGVYDISNKRRMGLTEYQAVKEMQDGILELIKIEKSM

SEQ ID NO: 924 - protein, 356 aa, Dermatophagoides farinae (American house dust mite)
MVDQATLSKLEAGFQKLQNAQDCHSLLKKYLTRDVLDQLKTKKTDMGATLLDVIQSGVENLDSGVGIYAPDAQSYKTFAALFDPIIDDYHKGFKPTDKHPQTDFGNIEHFVNVDPKNEYVISTRVRCGRSLKGYPFNPMLTEAQYKEMETKVKGQLATFEGELKGTYYPLLGMDKATQQKLIDDHFLFKEGDRFLQAANACRYWPVGRGIFHNDKKTFLMWVNEEDHLRIISMQKGGDLKEVFGRLVKAVKHIEQKIPFSRDDRLGYLTFCPTNLGTTIRASVHIKLPKLAADRKKLEEVAARYNLQVRGTAGEHTESVGGIYDISNKRRMGLTEYQAVKEMQDGIIELIKMEKSL

SEQ ID NO: 925 - protein, 136 aa, Dermatophagoides farinae (American house dust mite)
MKFIIFCAIVMAVSVSGFIVDVDTEDKWRNAFDHMLMEEFEEKMDQIEHGLLMLSEQYKELEKTKSKELKEQILRELTIAENYLRGALKFMQQEAKRTDLNMFERYNFETAVSTIEILVKDLAELAKKVKAVKSDD

SEQ ID NO: 926 - protein, 155 aa, Dermatophagoides farinae (American house dust mite)
MNRFLIVCMALFCLAAAVQADETNVQYKDCGHNEIKSFFVTGGNPNQKSCVIHKHSKNQLRISFVANENTGNKINTRFICNLGGIELGWPGIDGTDACQGHGLSCPLTKGQTYNYHLDFNLGDDVPTANVTATVRLENGHGGDLLCGRMHISLQN

SEQ ID NO: 927 - protein, 118 aa, Dermatophagoides farinae (American house dust mite)
MVHLTKTLRFINNPGFRKFYYGLQGYNKYGLYYDDFYDYTDAAHLEAVRRLPPDLYDQHTYRLVRASQLEITKQFLPKEQWPSYEEDMDKGRFLTPYLDEVMKEKKEKEEWINFLSKD

SEQ ID NO: 928 - protein, 247 aa, Dermatophagoides farinae (American house dust mite)
MGRKFFVGGNWKMNGNKTAIKEIVDFLKNGPLDSNVEVVVGVPAIYLMLCKNILPDNIRVAAQNCYKVDKGAFTGEISPAMIKDVGAEWVILGHSERRNVFGESDQLIGEKVEHALQEGLHVIACIGELLEEREAGKTTEVVFRQTQVISKHVKDWFKVVLAYEPVWAIGTGKTASPQQAQEVHQKLRQCFSENVSPQIAETIRIIYGGSVTANNAKELASQADVDGFLVGGASLKPEFVQIVNARQ

SEQ ID NO: 929 - protein, 247 aa, Dermatophagoides farinae (American house dust mite)
MVRKFFVGGNWKMNGSRATNEDLIKTLSNGPLDPNTDVVVGVPSIYMAEVRQKLPKTIGVAAQNCYKVPKGAFTGEISPAMIKDVGAEWVILGHSERRNVFGESDQLIGEKVEHALQEGLHVIACIGELLEEREAGKTTEVVFRQTQVISKHVKDWSKVVLAYEPVWAIGTGKTASPQQAQEVHQKLRQWFSENVSPQIAETIRIIYGGSVTANNAKELASQADVDGFLVGGASLKPEFVQIVNARQ

SEQ ID NO: 930 - protein, 160 aa, Dermatophagoides farinae (American house dust mite)
MADLRPPEVEKARLHFDIYDFDGQSKVDYHYLGDLLRSLDLRPTQDSVAKNGWEKKKGQKFMTFEEFLPIYSQVKKDKDCGAFEDLVEGLKVYDKAENGTMMEAELAHVLLSLGEKLTDAEVEEIIKTCGGGCDDEGFMKYETFIKNVMAGPFPEEAGKS

SEQ ID NO: 931 - protein, 427 aa, Dermatophagoides farinae (American house dust mite)
MKFFLLSFVLMIVAATATYAAHVGSGSRDNNNNKPVPAEGFAKASNEFGFHLLKEVIQHRSSSGSRGSSENVLFSPYSVAVALSMVHQGTQGSTAEQFKRVLYYDRVQQLNGGEYQTVANSVKQIQNQIKQSDQSNQFDWGNMLMVDQQIPVKDQYKKIIEQYYDGQVMSVDFRKESKNVMERINQFVSNKTHGLIDRMLEQPPSADTGLALINAVYFKGEWLKPFDSMRTEQSVFYGHHGQEYKNVQYINGQGPYGYVEVPQWNSDLIQLPYKGEDIAFYGVLPRERNYDLDKIRQSINSTFVDEIVGQITGGQSSTVYFPKIELSTSYQLPEILKSMGLQDVFTESADLSGITDKKPMKIDDAIHKAKLILNEQGTEAGAGTYIQMAVLSALETSHTFRFDHPFMYFIRHLPTGQILFLGEIHDF

SEQ ID NO: 932 - protein, 659 aa, Dermatophagoides farinae (American house dust mite)
MSKTPAIGIDLGTTYSCVGVFQHGKVEIIANDQGNRTTPSYVGFTDTERLIGDAAKNQVAMNPSNTVFDAKRLIGRKFDETTVQADMKHWPFKVIEKGNKPAIEVEFKGETKQFIPEEISSMVLVKMRETAEAYLGGTVNNAVITVPAYFNDSQRQATKDSGLIAGLNVLRIINEPTAAAIAYGLDKKGGAGERNVLIFDLGGGTFDVSLLTIEEGIFEVKSTAGDTHLGGEDFDNRLVNHFVKEFKRKHKKDLTTNARALRRLRTSCERAKRTLSSAAQTSIEIDSLFEGIDFYTSITRARFEELCADLFRSTMEPVERVLRDAKTDKSSVNEIVLVGGSTRIPKIQRLVADFFNKDPNKSINPDEAIAYGAAVQASILSGDTSSKSTNEILLLDVAPLSLGIETAGGVMTALIKRDTTIPTRSPRLSLPTPTTSLVSRFRSTRVSVLAPRTTTSLVSSSSPVSPCSSWCSSDRGHFDVDANGIMNVGAVEKGTGKTNKITITNDKGRLSKEEIERMLAEAEKYKAEDEAEAARIHAKNGPESYAYSLRNTVNEGKLSISDSDKEKLRARLTRLSTGSTTTRPPARRSTTLNRRSSRVLPTPSFWLPTVVLAVVVPPLVVTPVLVALVVLTRLRSALRSLTKKVFNGVFLFPVLFDVS

SEQ ID NO: 933 - protein, 654 aa, Dermatophagoides farinae (American house dust mite)
MPSKTLKAPAIGIDLGTTYSCVGVFQNGSVEIIANDQGNRTTPSYVAFNDTERLIGDAAKNQVSMNPTNTIFDAKRLIGRRFDESSVKSDMKHWPFKVVSESGKPKLEVEFKGERKRFWPEEISAMVLTKMKETAEAYLGQKVTDVVITVPAYFNDSQRQATKDAGVIAGLNVLRIINEPTAAAIAYGLDKKGGGEKNVLIFDLGGGTFDVSVLTIDNGIFEVKSTAGDTHLGGEDFDNRLVNHFVQEFKRKFGKDIMSNKRALRRLRTSCERAKRTLSSSTQTSIEIDSLHEGIDFYSTITRARFEELCSDLFRSTLEPVEKALRDAKLDKSKIDEIVLVGGSTRIPKIQKLLSDFFNGKELNKSINPDEAVAYGAAVQAAILTGDNSNNVKDLLLLDVAPLSLGIETAGGVMTTLIKRNTTIPTKQTQTFTTYADNQPAVTIQVYEGERAMTKDNNRLGTFDLTGIPPAPRGVPQIEVTFDVDANGILNVSAVDKSTGRQNKITITNDKGRLSKADIEKMVQEAEQYREDDERQRERIAAKNQLEAYAFQLKSTMEEEAVKSKLSEEDRKTVLNKVDETLRWLDSNQLADKEEFEHRQKEIENACRPIMMKIYQQQQQQHHPGANGSCGSNAYPGYNGFKSNNDGPVVEEVN

SEQ ID NO: 934 - protein, 164 aa, Dermatophagoides farinae (American house dust mite)
MALPRVFFDIAADNQPLGRIVIELRSDVVPKTAENFRALCTGEKGFGFKSSSFHRIIPNFMIQGGDFTNHNGTGGKSIYGNKFADENFTLQHTGPGIMSMANAGPNTNGSQFFITTVKTTWLDGKHVVFGSVVEGMDIVKKVESYGSQSGKPSKKVTIANCGQL

SEQ ID NO: 935 - protein, 171 aa, Dermatophagoides farinae (American house dust mite)
MAANPESTTKTSRVRMNIQINLEFYASYVYQQMAYHFNRDDVALPGFEKFFDVSSKEEREHAERFMKLQNQRGGRIVLDDIHKPQQQDWSSGLEAMRAALELEKTVNQALLDLHAVATKHNDAQFADFIETHYLTEQVEAIKKLADYITNLERCGPGLGEYLFDRHTLHSS

SEQ ID NO: 936 - protein, 148 aa, Dermatophagoides farinae (American house dust mite)
MASGVTVATEAKTLYEEVKKDKKYRYIIYHIKDERVIEVETTGPRDATYSDFVAKLQDYKNECRYCVFDFPANIPVEGGGEKSNMSVDRLVLMTWCPESAKIKQKMLYSSSYDALKKALVGVYKYVQACDYEEASEEAIAEAFRKGGK

SEQ ID NO: 937 - protein, 296 aa, Dermatophagoides farinae (American house dust mite)
MSTTNYSVDHRGSFNSLDYRIYFKDNSNGKIISPWHDIPLFVDKSAKHYNMVVEIPRWTNEKMEIATAEPMSPIKQDIKKGALRYVKNVFPHKGYIWNYGAFPQTWENPNHIDQDTKTKGDNDPIDVIEIGSRVAKRGDVVPVKILGTIALIDEGETDWKIIAIDTRDELASQMNNVDDVEKLLPGLLRATVEWFKIYKIPDGKPANKFAFNGEAKDREFAEKIVEETHQYWQEMMENKSGEHKLDLKNVTLGNSFSINDEQAKQFLETRPSSDAVEPTPIADQVAIDKWHHVKLI

SEQ ID NO: 938 - protein, 461 aa, Dermatophagoides farinae (American house dust mite)
MRECISLHVGQAGVQIGNACWELYCLEHEIQPDGQLSPVKSTTTLSSSETISNDSFSTFFNETGNGRFVPRSIYVDLEPTVVDEVRTGEYRRLFHPEQLITGKEDAANNYARGHYTEGKTLIEPVMRRIAKLAEQCSGLQGFLIFHSFGGGTGSGFSSLLMERLSVEYGKKSKLEFAIYPAPAISTAVVEPYNSILTTHNTLEHSDCSFMVDNEAIYDICRRNLNIERPSYMNLNRLIGQIVSSITASLRFDGALNVDLTEFQTNLVPYPRIHFPLVSYAPIVSSEKAYHEQFTVPEITGTCFEPSNQMVKCNTRNGKYMACCLLYRGDVVPKDVNAAIAAIKAKSTIQFVQWCPTGFKIGINYRPPTVVPSGDLAKVQRAVCLLSNTTAISEAWSRLNHKFDLMYSKRAFVHWYVGEGMEEGEFSEAREDLAALEKDYEEVAAEYNADDDDYDDRDGEEF

SEQ ID NO: 939 - protein, 30 aa, Dermatophagoides microceras (House dust mite)
TQACRINSGNVPSELDLRSLRTVTPIRMQG

SEQ ID NO: 940 - protein, 320 aa, Dermatophagoides pteronyssinus (European house dust mite)
MKIVLAIASLLALSAVYARPSSIKTFEEYKKAFNKSYATFEDEEAARKNFLESVKYVQSNGGAINHLSDLSLDEFKNRFLMSAEAFEHLKTQFDLNAETNACSINGNAPAEIDLRQMRTVTPIRMQGGCGSCWAFSGVAATESAYLAYRNQSLDLAEQELVDCASQHGCHGDTIPRGIEYIQHNGVVQESYYRYVAREQSCRRPNAQRFGISNYCQIYPPNVNKIREALAQTHSAIAVIIGIKDLDAFRHYDGRTIIQRDNGYQPNYHAVNIVGYSNAQGVDYWIVRNSWDTNWGDNGYGYFAANIDLMMIEEYPYVVIL

SEQ ID NO: 941 - protein, 320 aa, Dermatophagoides pteronyssinus (European house dust mite); identical to SEQ ID NO: 940

SEQ ID NO: 942 - protein, 302 aa, Dermatophagoides pteronyssinus (European house dust mite)
RPSSIKPFEEYKKAFNKSYATFEDEEAARKNFLESVKYVQSNGGAINHLSDLSLDEFKNRFLMSAEAFEHLKTQFDLNAETNACSINGNAPAEIDLRQMRTVTPIRMQGGCGSCWAFSGVAATESAYLAYRNQSLDLAEQELVDCASQHGCHGDTIPRGIEYIQHNGVVQESYYRYVAREQSCRRPNAQRFGISNYCQIYPPNANKIREALAQTHSAIAVIIGIKDLDAFRHYDGRTIIQRDNGYQPNYHAVNIVGYSNAQGVDYWIVRNSWDTNWGDNGYGYFAANIDLMMIEEYPYVVIL

SEQ ID NO: 943 - protein, 302 aa, Dermatophagoides pteronyssinus (European house dust mite); identical to SEQ ID NO: 942

SEQ ID NO: 944 - protein, 302 aa, Dermatophagoides pteronyssinus (European house dust mite)
RPSSIKTFEEYKKAFNKSYATFEDEEAARKNFLESVKYVQSNGGAINHLSDLSLDEFKNRFLMSAEAFEHLKTQFDLNAETNACSINGNAPAEIDLRQMRTVTPIRMQGGCGSCWAFSGVAATESAYLAYRNQSLDLAEQELVDCASQHGCNGDTIPRGIEYIQHNGVVQESYYRYVAREQSCRRPNAQRFGISNYCQIYPPNANKIREALAQTHSAIAVIIGIKDLDAFRHYDGRTIIQRDNGYQPNYHAVNIVGYSNAQGVDYWIVRNSWDTNWGDNGYGYFAANIDLMMIEEYPYVVIL

SEQ ID NO: 945 - protein, 146 aa, Dermatophagoides pteronyssinus (European house dust mite)
MMYKILCLSLLVAAVARDQVDVKDCANHEIKKVLVPGCHGSEPCIIHRGKPFQLEAVFEANQNTKTAKIEIKASIDGLEVDVPGIDPNACHYMKCPLVKGQQYDIKYTWNVPKIAPKSENVVVTVKVMGDDGVLACAIATHAKIRD

SEQ ID NO: 946 - protein, 146 aa, Dermatophagoides pteronyssinus (European house dust mite); identical to SEQ ID NO: 945

SEQ ID NO: 947 - protein, 129 aa, Dermatophagoides pteronyssinus (European house dust mite)
DQVDVKDCANHEIKKVLVPGCHGSEPCIIHRGKPFQLEAVFEANQNSKTAKIEIKASIDGLEVDVPGIDPNACHYMKCPLVKGQQYDIKYTWNVPKIAPKSENVVVTVKVMGDNGVLACAIATHAKIRD

SEQ ID NO: 948 - protein, 146 aa, Dermatophagoides pteronyssinus (European house dust mite)
MMYKILCLSLLVAAVAADQVDVKDCANHEIKKVLVPGCHGSEPCIIHRGKPFQLEALFEANQNTKNAKIEIKASIDGLEVDVPGIDPNACHYVKCPLVKGQQYDIKYTWNVPKIAPKSENVVVTVKVLGDNGVLACAIATHAKIRD

SEQ ID NO: 949 - protein, 261 aa, Dermatophagoides pteronyssinus (European house dust mite)
MIIYNILIVLLLAINTLANPILPASPNATIVGGEKALAGECPYQISLQSSSHFCGGTILDEYWILTAAHCVAGQTASKLSIRYNSLKHSLGGEKISVAKIFAHEKYDSYQIDNDIALIKLKSPMKLNQKNAKAVGLPAKGSDVKVGDQVRVSGWGYLEEGSYSLPSELRRVDIAVVSRKECNELYSKANAEVTDNMICGGDVANGGKDSCQGDSGGPVVDVKNNQVVGIVSWGYGCARKGYPGVYTRVGNFIDWIESKRSQ

SEQ ID NO: 950 - protein, 496 aa, Dermatophagoides pteronyssinus (European house dust mite)
KYHNPHFIGNRSVITHLMEWKYDDIGDECERFLGPYGYGGVQVSPVNEHAILDRRPWYERYQPVSYDIRTRSGDEQQFRRMVKRCNKAGVRIYVDIVLNHMTGAQSGKGTNGHHYDGNTLQYPGVPFGPNDFHGHESCPTQDLEIHDYTNPKEARNCRLSGLRDLKQQSEYVRQKQVDFLNHLIDIGVAGFRSDASTHQWPDDLRSIYSRLHNLNKEFFPENSQPFIYHETIYYGGNGINSNEYTSLGRIIEFRFYKEITNVFRGNNPLHWLKNFGTEWGLVPSGDALVMIDSHDLRVGHTGKLGFNINCFEGRLLKAATAFMLAWNYGVPRVMSSYFWNQIIKDGKDVNDWVGPPSDKNGNILSVHPNPDMTCNHEWICEHRWREIYNMVKFRMIAGQEPVHNWWDNGDYQIAFSRGNRAFIAINLQKNQQNLQQKLHTGLPAGTYCDIISGNLIDNKCTGKSIHVDKNGQADVYVGHDEFDAFVAYHIGARIVS

SEQ ID NO: 951 - protein, 148 aa, Dermatophagoides pteronyssinus (European house dust mite)
LFLENKDPKPLKKISIMKFIIAFFVATLAVMTVSGEDKKHDYQNEFDFLLMERIHEQIKKGELALFYLQEQINHFEEKPTKEMKDKIVAEMDTIIAMIDGVRGVLDRLMQRKDLDIFEQYNLEMAKKSGDILERDLKKEEARVKKIEV

SEQ ID NO: 952 - protein, 132 aa, Dermatophagoides pteronyssinus (European house dust mite)
MKFIIAFFVATLAVMTVSGEDKKHDYQNEFDFLLMERIHEQIKKGELALFYLQEQINHFEAKPTKEMKDKIVAEMDTIIAMIDGVRGVLDRLMQRKDLDIFEQYNLEMAKKSGDILERDLKKEEARVKKIEV

SEQ ID NO: 953 - protein, 20 aa, Dermatophagoides pteronyssinus (European house dust mite)
  misc_feature (4)..(4): Xaa can be any naturally occurring amino acid
AIGXQPAAEAEAPFQISLMK

SEQ ID NO: 954 - protein, 215 aa, Dermatophagoides pteronyssinus (European house dust mite)
MMKLLLIAAAAFVAVSADPIHYDKITEEINKAVDEAVAAIEKSETFDPMKVPDHSDKFERHIGIIDLKGELDMRNIQVRGLKQMKRVGDANVKSEDGVVKAHLLVGVHDDVVSMEYDLAYKLGDLHPNTHVISDIQDFVVELSLEVSEEGNMTLTSFEVRQFANVVNHIGGLSILDPIFAVLSDVLTAIFQDTVRAEMTKVLAPAFKKELERNNQ

SEQ ID NO: 955 - protein, 219 aa, Dermatophagoides pteronyssinus (European house dust mite)
MSQPILGYWDIRGYAQPIRLLLTYSGVDFVDKRYQIGPAPDFDRSEWLNEKFNLGLDFPNLPYYIDGDMKMTQTFAILRYLGRKYKLNGSNDHEEIRISMAEQQTEDMMAAMIRVCYDANCDKLKPDYLKSLPDCLKLMSKFVGEHAFIAGANISYVDFNLYEYLCHVKVMVPEVFGQFENLKRYVERMESLPRVSDYIKKQQPKTFNAPTSKWNASYA

SEQ ID NO: 956 - protein, 273 aa, Dermatophagoides pteronyssinus (European house dust mite)
MKFMILFALIAIGTSVAIGEQAIRLPLPDAITEKFPWMINEPLNDERERIVGGSNASPGDAVYQIALFRKDSFTCGGSLISSRTVLTAAHCVFGDEATPSYFKIRYNTLDRTNGPPIGVSKIYRHNLYSSSPIDYDVATLILSQPFTPSANADIIPLTTSEPADGTKLQITGWGRLKSGGTLPTILQIASVTKMSRTKCSSTWGSVNAITNRMLCAHNSNQASCNGDSGGPLVSNGHLVGVVSWGPSTCLSTKYPTIYSNVANLRNWIISNTV

SEQ ID NO: 957 - protein, 261 aa, Dermatophagoides pteronyssinus (European house dust mite)
ILFLRFVEEKRIIIMKFIILFALIAIGTSVAIGEQAIRLPLPDAITEKFPWMINEPLNDERERIVGGSNASPGDAVYQIALFRKDSFTCGGSLISSRTVLTAAHCVFGDEATPSYFKIRYNTLDRTNGPTIGVSKIYRHNLYSSSTIDYDVATLILSQPFTPSANADIIPLTTSEPADGTKLQITGWGRLKSGGTLPTILQIASVTKMSRTKCSSTWGSVNAITNRMLCAHNSKQASCNGDSGGPLVSNGHLVGGKFSWGP

SEQ ID NO: 958 - protein, 284 aa, Dermatophagoides pteronyssinus (European house dust mite)
MEAIKNKMQAMKLEKDNAIDRAEIAEQKARDANLRAEKSEEEVRALQKKIQQIENELDQVQEQLSAANTKLEEKEKALQTAEGDVAALNRRIQLIEEDLERSEERLKIATAKLEEASQSADESERMRKMLEHRSITDEERMEGLENQLKEARMMAEDADRKYDEVARKLAMVEADLERAEERAETGESKIVELEEELRVVGNNLKSLEVSEEKAQQREEAHEQQIRIMTTKLKEAEARAEFAERSVQKLQKEVGRLEDELVHEKEKYKSISDELDQTFAELTGY

SEQ ID NO: 959 - protein, 875 aa, Dermatophagoides pteronyssinus (European house dust mite)
MSARTAKYMYRSSGAGASGDISVEYGTDLGALTRLEDKIRLLSDDLESEREMRQRIEREKAELQIQVMSLSERLEEAEGSSESVTEMNKKRDSELAKLRKLLEDVHMESEETAHHLRQKHQAAVHEMQDQLDQLQKAKNKSDKEKQKFQAEVFELLSQLETANKEKLTALKSVEKLEYTVHELNIKIEEINRTVIELTSHKQRLTQENTELIKEVHEVKLQLDNANHLKQQIAQQLEDTRHRLEEEERKRSSLENHAHTLEVELESLKVQLDDESEARLELERQLTKANGDAASWKSKYEAELQAHADEVEELRRKMAQKISEYEEQLEALLNKCSSLEKQKSRLQSEVEVLIMDLEKAAAHAQQLEKRVAQLEKINLDLKDKLEEVTMLMEQAQKELRIKIGELQKLQHEYEKVRDQRDQLARENKKLTDDLAEAKSQLNDAHRRIHEQEIEIKRLENERDELSAAYKEAETLRKQEEAKNQRLIAELAQVRHDYEKRLAQKDEEIEALRKQYQIEIEQLNMRLAEAEAKLKTEIARLKKKYQAQITELELSLDAANKANIDLQKTIKKQALQITELQAHYDEVHRQLQQAVDQLGVTQRRCQALQAELEEMRIALEQASRAKRQAEQLHEEAVVRVNELTTINVNLASAKSKLESEFSALQADYDEVHKELRISDERVQKLTIELKSTKDLLIEEQERLVKLETVKKSLEQEVRTLHVRIEEVEANALAGGKRVIAKLESRIRDVEIEVEEERRRHAETEKMLRKKDHRVKELLLQNEEDHKQIQLLQEMTDKLNEKVKVYKRQMQEQEGMSQQNLTRVRRFQRELEAAEDRADQAESNLSFIRAKHRSWVTTSQVPGGTRQVFTTQEETTNY

SEQ ID NO: 960 - protein, 131 aa, Dermatophagoides pteronyssinus (European house dust mite)
MASIEGKYKLEKSEKFDEFLDKLGVGFMVKTAAKTLKPTFEVAKENDQYVFRSLSTFKNTEIKFKLGEEFEEDRADGKRVKTVINKDGDNKFVQTQFGDKEVKIVREFNGDEVVVTASCDGVTSVRTYKRI

SEQ ID NO: 961 - protein, 1662 aa, Dermatophagoides pteronyssinus (European house dust mite)
LLTACLLGLGQAQHCEVACPRSIPQLINPKAQSTYVYSLDAKTVLTPRDSQKVTIKGDAEVAFVSDCEAVLRLQNVAIDGVPNGAELAAELAAKPFAFGYFNGRILGVCPADDDQDWSLNVKKAIVSSLQALSDGNVEKAEEIDFSGRCPTEYRKIRSQDDNTVVIEKRKDLNLCDDRRIDLRQTPDQALGQLKELMRHYMHPMDSDLSCRMTLKDKVVTEVDCEERHVLVHRSNKPVHMSYVKMMLKQNKDGVAADLGPTNAQPKRPYLSFDHKHKNPTETDVVEVLKKLCSEITEPQASIETSFTFQKLVDKLRYLSAEETASVDESVKTSVCPAHAHRLRELFLDASAFAASDGSIRTLVKAHENQELSITRSTALFTVAAIKAAPNKETVQVLLPVIASEKTIRPMLLGFSVLVRRYCEKTNDCATNSGVKDARDAYLARLAVARDASERMTIVRALENLNVNTDGVDNMVNAMDEIIKSTDAEPAMRAAAVNALPNDASHMDRYKSLVMDESMPNEARIAAFQKMMKNGGMSHIKDLFAVKGECMKNYVLTYVDNLKKSKNDLRRQTVGEDVELPEKPKREIGITRNIAREYGPYTFEYDVIYPETHENVTRSINGRLIRSKNDQLKELVEFQVTQSGFDRELNNAMSLLEKKSFQSVMQFLRDMLKMLSQIRKNADDNHHMKITVQINGKNVYFTDLFQDTKKMKELLMKRVEKIINDKKVDRSIGGVLLDSKLVLPTITGLPLMYKFGDNLVVRYDGEFSGEKGDRNIRMNGGVVAGLYGKMKLMVKDHKMGYEYDAKASYTPMIDMNVQKQEHSLLVRFNMKDMDQHTVMRFKQSLREKRATGEEKDYENEITPDARSDRCFSFFLLDYCRKASHIKGLMLPNVEYYVVKPEKEVTALELMLKSETQDKTRRYIAEMTAVGSPSNKQAKAELEVTKGEQYRVSVKLPEHEFNTEFTINADKNNLKMHMDLPNVLQADLTGSFEHDKENNVRKNRLNLQYKFAGDEKPHTVDYENEFLFNLKRSSKEKNSAVEYRAKYMSSHFPILNHKVNVQFKYRPFKVNELNLEGEFGRELQHKFRLMRNSQMEVEEVRPFKMHGNSDIKLMANDLDIDYDLKSEFKYESNKGTPIELQYKVSGKDRSKRAAEMNAEDVEGVIDYKNSGSPIDSKMHAHLKVKGNNYGYDSELKQTEPQQYEGKMTLSKNDKKIFITHKTEMTKPTSTFLLKTDADVSYSESDMKKHYHMEFKKENDIYTLRSTVERDGQLFYENYLTVHKGGKLNLNYRRNDRKILLDLDNALSPREGTMKLNIKDREYNFVLKRDPMRYRDITVEGNENAYVKNGKLHLSLIDPSTLSLVTKADGQIDMTVDLISPITKRASLKVDSKKYNLFHEGELSASLVNPRLSWHQYTKRDSREYKTDVDLSLRSSDIAVKITMPDYNSKIHYSRQNDQISMDIDGTLIEGHAKGTIKEGKIHIKGRQSDFEIESNYRYEDGKMLIEPVKSENGKLEGVLSRKVPSHLTLETPRVKMNMQYDRHSPVKMFKLDYDGIHLEKHTDLLYEPGVQYKIIGNGKIKDDGSHYSIDIQGKPRKAFKLDADMMNFKLNVNKPEDSNKAQFSYTFNDYTETEEYEFDPHRAYYINWISSIRKYIQNFIVEDH

SEQ ID NO: 962 - protein, 532 aa, Dermatophagoides pteronyssinus (European house dust mite)
MKTSCAILILMACFGLMNAAVKRDHNNYSKNPMRIVCYVGTWSVYHKVDPYTIEDIDPFKCTHLMYGFAKIDEYKYTIQVFDPYQDDNHNTWEKHGYERFNNLRLKNPELTTMISLGGWYEGSEKYSDMVANPTYRKQFVQSVLDFLQEYKFDGLDLDWEYPGSRLGNPKIDKQNYLTLVRELKEAFEPFGYLLTAAVSPGKDKIDVAYELKELNQLFDWMNVMTYDYHGGWENVFGHNAPLYKRPDETDELHTYFNVNYTMHYYLNNGATRDKLVMGVPFYGRAWSIEDRSKVKLGDPAKGMSPPGFITGEEGVLSYIELCQLFQKEEWHIQYDEYYNAPYGYNDKIWVGYDDLASISCKLAFLKELGVSGVMIWSLENDDFKGHCGPKYPLLNKVHNMINGDEKNSYECLLGPSTTTPTPTTPSTPSTTTPTPTTPSTPSTTTPTPTTPSTPSTTTPTPTTTDSTSETPKYTTYVDGHLIKCYKEGDLPHPTNIHKYLVCEYVNGGWWVHIMPCPPGTIWCQEKLTCITE

SEQ ID NO: 963 - protein, 558 aa, Dermatophagoides pteronyssinus (European house dust mite)
MKTSCAILILMACFGLMNAAVKRDHNNYSKNPMRIVCYVGTWSVYHKVDPYTIEDIDPFKCTHLMYGFAKIDEYKYTIQVFDPYQDDNHNTWEKHGYERFNNLRLKNPELTTMISLGGWYEGSEKYSDMVANPTYRQQFVQSVLDFLQEYKFDGLDLDWEYPGSRLGNPKIDKQNYLTLVRELKEAFEPFGYLLTAAVSPGKDKIDVAYELKELNQLFDWMNVMTYDYHGGWENVFGHNAPLYKRPDETDELHTYFNVNYTMHYYLNNGATRDKLVMGVPFYGRAWSIEDRSKVKLGDPAKGMSPPGFITGEEGVLSYIELCQLFQKEEWHIQYDEYYNAPYGYNDKIWVGYDDLASISCKLAFLKELGVSGVMIWSLENDDFKGHCGPKYPLLNKVHNMINGDEKNSYECLLGPSTTTPTPTTPSTPSTTTPTPTTPSTPSTTTPTPTTPSTPSTTTPTPTTPSTPSTTTPTPTTPSTTSTTTPTPTTTDSTSETPKYTTYVDGHLIKCYKEGDLPHPTNIHKYLVCEYVNGGWWVHIMPCPPGTIWCQEKLTCITE

SEQ ID NO: 964 - protein, 462 aa, Dermatophagoides pteronyssinus (European house dust mite)
MTRLSFTVLIFLAAYFGSNIRPNVATLDPKTVCYYESWVHWRQGDGKMDPEDIDTSLCSHIVYSYFGIDASSHEIKLLDQYLMITLHDMEHFTKHKGNAKAMIAVGGASMSDQFSKTAAVEHYRETFVVSTIDLMTKYGFDGVMIDWSGMQAKDSDNFVKLLDKFDEKFAQTSFVMGVTLPATIASYDNYNIPAISNYVDFMNVLTLDYDGPWAYTVGHASALPEQLKTLEAYNKRGAPRHKMVMAVPFFARTWILEKMDKQDVGDKASGPGPKGQFTQTPGFLSYNELCVQIQAETNAFSITRDHDNTAIYAVYVHDNHAEWISFEDRHTLGDKARNITEQGYGGMSVYTLSNEDVHGVCGDKNPLLHAINSNYFRGIVTEPTVVTVTPVTHTTEHVTDIPGVFHCHQEGFFRDKTYCAKYYECKKGDFGLEQTVHHCPNHSQAFDEVSRTCVDHAKIPGC

SEQ ID NO: 965 - protein, 356 aa, Dermatophagoides pteronyssinus (European house dust mite)
MVDPATLSKLEAGFQKLQNAQDCHSLLKKYLTRDVFDQLKNKKTDMGATLLDVIQSGVENLDSGVGIYAPDAQSYKTFAALFDPIIDDYHKGFKPTDKHPKTDFGNIENFVNVDPKNEYVLSTRVRCGRSLNGYPFNPMLTEAQYKEMETKVKGQLATFEGELKGTYYPLLGMDKATQQQLIDDHFLFKEGDRFLQAANACRYWPVGRGIFHNDKKTFLMWVNEEDHLRIISMQKGGDLKEVYGRLVKAVKHIEQKIPFSRDDRLGFLTFCPTNLGTTIRASVHIKLPKLAADRKKLEEVAGRYNLQVRGTAGEHTESVGGIYDISNKRRMGLTEYQAVKEMQDGILELIKMEKSM

SEQ ID NO: 966 - protein, 140 aa, Dermatophagoides pteronyssinus (European house dust mite)
MKFIITLFAAIVMAAAVSGFIVGDKKEDEWRMAFDRLMMEELETKIDQVEKGLLHLSEQYKELEKTKSKELKEQILRELTIGENFMKGALKFFEMEAKRTDLNMFERYNYEFALESIKLLIKKLDELAKKVKAVNPDEYY

SEQ ID NO: 967 - protein, 90 aa, Dermatophagoides pteronyssinus (European house dust mite)
MKFNIIIVFISLAILVHSSYAANDNDDDPTTTVHPTTTEQPDDKFECPSRFGYFADPKDPHKFYICSNWEAVHKDCPGNTRWNEDEETCT

SEQ ID NO: 968 - protein, 118 aa, Dermatophagoides pteronyssinus (European house dust mite)
MVHLTKTLRFINNPGFRKFYYGLQGYNKYGLYYDDFYDYTDPAHLEAVRRLPPDLYDQHTYRVIRASQLEITKQFLPKEQWPSYEEDMDKGRFLTPYLDEVMKEKKEKEEWVNFLSKD

SEQ ID NO: 969 - protein, 203 aa, Dolichovespula arenaria (Yellow hornet)
NNYCKICPKGTHTLCKYGTSMKPNCGGKIVKSYGVTNDEKNEIVKRHNEFRQKVAQGLETRGNPGPQPPAKNMNLLVWNDELAKIAQTWANQCNFGHDQCRNTAKYPVGQNVAIASTTGNSYQTMSYLIKMWEDEVKDYNPHKDLMHNNFSKVGHYTQMVWGKTKEIGCGSVKYIENKWHTHYLVCNYGPAGNYMNQPVYERK

SEQ ID NO: 970 - protein, 317 aa, Dolichovespula maculata (White face hornet)
RLIMFVGDPSSSNELDRFSVCPFSNDTVKMIFLTRENRKHDFYTLDTMNRHNEFKKSIIKRPVVFITHGFTSSATEKNFVAMSEALMHTGDFLIIMVDWRMAACTDEYPGLKYMFYKAAVGNTRLVGNFIAMIAKKLVEQYKVPMTNIRLVGHSLGAHISGFAGKRVQELKLGKFSEIIGLDPAGPSFKKNDCSERICETDAHYVQILHTSSNLGTERTLGTVDFYINNGSNQPGCRYIIGETCSHTRAVKYFTECIRRECCLIGVPQSKNPQPVSKCTRNECVCVGLNAKKYPKRGSFYVPVEAEAPYCNNNGKII

SEQ ID NO: 971 - protein, 303 aa, Dolichovespula maculata (White face hornet)
GILPECKLVPEEISFVLSTRENRDGVYLTLQKLKNGKMFKNSDLSSKKVPFLIHGFISSATNKNYADMTRALLDKDDIMVISIDWRDGACSNEFALLKFIGYPKAVENTRAVGKYIADFSKILIQKYKVLLENIRLIGHSLGAQIAGFAGKEFQRFKLGKYPEIIGLDPAGPSFKKKDCPERICETDAHYVQILHTSSNLGTERTLGTVDFYINDGSNQPGCTYIIGETCSHTRAVKYLTECIRRECCLIGVPQSKNPQPVSKCTRNECVCVGLNAKEYPKKGSFYVPVEAKAPFCNNNGKII

SEQ ID NO: 972 - protein, 331 aa, Dolichovespula maculata (White face hornet)
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 973 - protein, 227 aa, Dolichovespula maculata (White face hornet)
MEIGGLVYLILIITIINLSFGETNNYCKIKCRKGIHTLCKFGTSMKPNCGRNVVKAYGLTNDEKNEILKRHNDFRQNVAKGLETRGKPGPQPPAKNMNVLVWNDELAKIAQTWANQCDFNHDDCRNTAKYQVGQNIAISSTTATQFDRPSKLIKQWEDEVTEFNYKVGLQNSNFRKVGHYTQMVWGKTKEIGCGSIKYIEDNWYTHYLVCNYGPGGNDFNQPIYERK

SEQ ID NO: 974 - protein, 215 aa, Dolichovespula maculata (White face hornet)
PIINLSFGEANNYCKIKCSRGIHTLCKFGTSMKPNCGSKLVKVHGVSNDEKNEIVNRHNQFRQKVAKGLETRGNPGPQPPAKNMNVLVWNDELAKIAQTWANQCSFGHDQCRNTEKYQVGQNVAIASTTGNSYATMSKLIEMWENEVKDFNPKKGTMGDNNFSKVGHYTQMVWGKTKEIGCGSVKYIENNWHTHYLVCNYGPAGNYMDQPIYERK

SEQ ID NO: 975 - protein, 252 aa, Eriocheir sinensis (Eriocheir sinensis)
MWCSILLAAVMVAVAGGQSRFSYDGTPLADDVVVGSGQRQQFFASRQPRPQQLFVQERPQQVFVQQQPQPPVFVQPEPQQVFVQPQPRPMFQMLPSFSQQAAVIQSVQPQVSSACPATYSLVHTTYQGRVYHSSWCNLPGHRFSQSAARDYCRGLGEVTVMNRRGSFDLYSVDRTTDFDYFFELLLQHQIPSVWTRDLASTAPYEIRGSITRSGDSTAGQDCLSLEASTDGLFLLQDSCSDRKAAVCVAHWQ

SEQ ID NO: 976 - protein, 321 aa, Euroglyphus maynei (House dust mite)
MKIILAIASLLVLSAVYARPASIKTFEEFKKAFNKTYATPEKEEVARKNFLESLKYVESNKGAINHLSDLSLDEFKNQFLMNANAFEQLKTQFDLNAETYACSINSVSLPSELDLRSLRTVTPIRMQGGCGSCWAFSGVASTESAYLAYRNMSLDLAEQELVDCASQNGCHGDTIPRGIEYIQQNGVVQEHYYPYVAREQSCHRPNAQRYGLKNYCQISPPDSNKIRQALTQTHTAVAVIIGIKDLNAFRHYDGRTIMQHDNGYQPNYHAVNIVGYGNTQGVDYWIVRNSWDTTWGDNGYGYFAANINLMMIEQYPYVVML

SEQ ID NO: 977 - protein, 145 aa, Euroglyphus maynei (House dust mite)
MYKILCLSLLVAAVAADQVDIKDCANHEIKKVMVPGCKGSEPCVIHRGTAFQLEAVFDANQNSNAAKIEIKATIDGVEIDVPGIDNNLCHFMKCPLVKGQEYDIKYTWNVPRIAPKSENVVVTVKLLGDNGVLACAIATHAKIRD

SEQ ID NO: 978 - protein, 261 aa, Euroglyphus maynei (House dust mite)
MVICNAIIVLLLAFNTLANPILPSSPNATIVGGQKAKAGECPYQISLQSSSHFCGGTILDEYWILTAAHCVNGQTASKLSIRYNSLKHASGGEKLSVAQIYQHEKYDSWTIDNDIALIKLQSPMTLDQKNAKSVQLPSQGSDVKVGDKVRVSGWGYLKEGSYSLPSDMYRVDIDIVAREQCNKLYEEAGATITDNMICGGNVADGGVDSCQGDSGGPVVDVASNQIVGIVSWGYGCARKGYPGVYTRVGSFIDWIDSKRSQ

SEQ ID NO: 979 - protein, 521 aa, Euroglyphus maynei (House dust mite)
MLPKIYLKLITVLFISLFVQNNVHCKYHNPHFIGNRCVITHLMEWKYDDIGDECERFLGPYGYGGVQVSPVNEHAILDRRPWYERYQPVSYDLRTRSGDEQQFRRMVKRCNKAGVRIYVDIVLNHMTGGQSGQGTNGNHYNGITMQYPGVPFGPNDFHGHESCQTKDLEIHNYSDRNEARNCRLSGLRDLKQQSEYVRKKQVDFLNHLIDIGVAGFRSDASTHQWPDDLRSIYSQLHTLNKEFFPENSHPFIYHETIYYGGNGINSNEYTSLGRIIEFRFYKEITNVFRGNNQLRWLKNFGTEWGLVPSNDALVMIDSHDLRVGHTGKLGFNINCFEARLLKASTAFMLAWNYGIPRVMSSYFWNQIIRDGKDVNDWVGPPTDQHGNILSVHPNADLTCNHEWICEHRWRQIYNMVRFKMIAGQEPVRNWWDNGDYQIAFSRGSHAFIAINLQKNGDKNLRQRLHTGLPAGTYCDIISGDLIHNKCTGKSIQVDKNGLADIYVGHDELDAFVAYHIGARIE

SEQ ID NO: 980 - protein, 1668 aa, Euroglyphus maynei (House dust mite)
MRVIALLLTACLLGLGQAQHCTVACPKSIPQLINPKAQSTYVYSLDAKTVLTPRDSQKVTIKADAEVAIVSSCEAVLRLQNVAIDGVPNGAELAAELAAKSFAFGYFNGRILGVCPANDDQDWSLNVKKAIVSALQVQFDENKDKVEETDFSGTCPTEYRKIRSDDDNTVVMEKRKDLNLCDDRRVDLRQTPDQALGQLKEIIRHYMHPMDSDLMCRMTLKDKVVSEVDCEERHVLVHRSHKPIHLSYVKMMLKQSKDGVAADLGQTDSEPKRPYLSFDHKHKNPTETDVVQVLKKLCTEITEPQASIETSFTFHKLVDKLRYLSAEETATVDESVKTAICPAHAKRIRELFLDASAFAASDGSIRTLVKAHENQELSVTRSTALFTVAAIKAAPNKETVNVLLPVIASEKTIRPMLLGFSVLVRRYCEKSADCASNSGVKDARDAYLARLAVAKDPSERMTIVRALENLNVNTEDVDNMINAMDEIIKSTDAEPSLRAAAVNALPSDASHMDRYKSLVMDESMPNEARIAAFHKMMQNGGMTHIKDLFAVKGDCMKNYVLTYVDNMQKSNNDLRRRTVAADVELPEKPKREMGITRNIAREYGPYTFEYDVIYPETHENVTRSINGRLIRAKNDKLKELVQIQITQNGFDRELNNAMSLLEKKSFQSVMQFVRDTLKMLAQIRKNADDNHHMKVSVKVNGKNVYYTDVFQDLKKLKELLVKRAEKIINEKKVDRSIGGVLLDSKLALPTITGLPLVYKFGDNFVLRYDGEFSGEKGDRHIRLNGGVVAGFYGRVKLLVKDQKMGYEYDGKLAYTPLVDMDIQKKEHSLLLRFNTKDVDQHTVFRFKQSLREKRATGEEKDYENEVTPESRSDRCFSFFLMNYCRKASHIKGLILPNVEYYVMKPEKEVTALELLLKSETEDKTRRYMAELTAVGSPSNKQARAQLEVTKGEQYRVTLKLPEHEFNTEFTINSDKNNLKMHMDFPNVLQADLTGSFEHDKENNVRKNRLNLQYKFANDDQPHTVEYENEFSFNLKRSSKEKNSGLDYRAKYVSSHFPILNHKLNVQFKYRPFKVNELNLEGEFGREFQHKFQLMRNSQMEVEEVRPFKMHGNSDIKLMANDLDIDLDLKSEFKYESNKGTPIELQYKVSGKDRSKRAAELGAEDVEGVIDYKNNGSPIDSKMHAHLKAKGNHYEYDSELKQTQPQQYEGKITMSKNDKKIFINHKSEMTKPTNTFHLKTDADVSYSDSEMKKHYQMEFKKENDIYTLRSTVERDGQLFYENYLTIHKGGKLNLNYRRNDRKILLDLDNALSPREGTMKLNIKDREYNFALKRDPLRYRDITVEGNENAYVKHGKLHLSLMDPSTLSLVTKADGKIDMTVDLISPVTKRASLKIDSKKYNLFHEGELSASLMNPRLSWHQYTKRDSREYKSDVDLSLRSSDIALKITMPDYNSKIHYSRQNDQLNLDIDGTLIEGHAQGTVKEGKIHIKGKQSDFEIESNYRYEDGKVLIEPVKSENGKLEGVLSRKVPSHLTLETPRVKMNMQYDRHAPVKMFKLDYDGIHFEKHTDIQYEPGVRYTIVGNGKLKDDGSHYSIDVQGKPRKAFKLDADMMNFKLKVDKPEDSNKAQFSYTFNDYTETEEYEFDPHRAYYVNWLSSIRKYIQTFIVEDH

SEQ ID NO: 981 - protein, 118 aa, Forcipomyia taiwana (Biting midge)
GTRVDEIKGHPFFREIDWTKELRNQKAPYEPKIKYPTDTSNFDPIDPDKLHDSSNADDYMIEEFFGSGKPCHHGFFEFTFRRFFDDDADCKISLNHGNSGDRNDNNNSNDNQSGAIYV

SEQ ID NO: 982 - protein, 325 aa, Forcipomyia taiwana (Biting midge)
MKPLMMQGHERAITQIKYNREGDLLFSCAKDHKPNVWFSLNGERLGTFNGHAGAVWCVDVDWTTTKLITGSGDMSVRLWDVETGTSVACIPCKSSARTVGFSFSGNQAAYSTDRAMGHICELFVIDSREPDSSLNDGDAILKIPISQSKITAMIWGTLDETIITGHENGQITLWDLRIGREINSVNDHMGAINDLQLSKDGTMFVSSSRDTTAKLFDSDSLMCLKTYKTERPVNSAAISPLLEHVVLGGGQDAMEVTTTSARQGKFDSRFFHLIYEEEFARVKGHFGPINSLAFHPDGRSYATGGEDGFVRLQTFDSSYYEYIFD

SEQ ID NO: 983 - protein, 259 aa, Glossina morsitans (Savannah Tsetse Fly)
MNFVLATLSLLILGSAAVGGDYCGLCDNHDACVMQNVFQSGCPSGAKMIDLNKYQSALLDAHNKKRNHVAGGGESKLKRACQMATMKWDSELAKLAEYNVKQCQMNHDRCRNTVKFKYAGQNLAELGRSGGPPPDYRKLIEKAVDKWYEEVKDCNQGYIDSYPMNYRGPAIGHFTVMVAERNTHVGCAASEYTKSNGFQYFLMACNYATTNMMEFPIYKSCGSSAQDCKSGKNSKYPNLCSPNEKYEVNKWIKNGVEYH

SEQ ID NO: 984 - protein, 128 aa, Glycyphagus domesticus (Storage mite)
GKMNFTDCGHNEIKELSVSNCTGNYCVIHRGKPLTLDAKFDANQDTASVGLVLTAIIDGDIAIDIPGLETNACKLMKCPIRKGEHQELIYNIGEIPDATPEIKAKVKAQLIGEHGVLACGWVDGEVQE

SEQ ID NO: 985 - protein, 125 aa, Glycyphagus domesticus (Storage mite)
GKMKFKDCGKGEVTELDITDCSGDFCVIHRGKPLTLEAKFAANQDTTKATIKVLAKVAGTPIQVPGLETDGCKFVKCPIKKGDPIDFKYTTTVPAILPKVKAEVTAELVGDHGVLACGRFGRQVE

SEQ ID NO: 986 - protein, 284 aa, Homarus americanus (American lobster)
MDAIKKKMQAMKLEKDNAMDRADTLEQQNKEANIRAEKTEEEIRITHKKMQQVENELDQVQEQLSLANTKLEEKEKALQNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLANKLKAAEARAEFAERSVQKLQKEVDRLEDELVNEKEKYKSITDELDQTFSELSGY

SEQ ID NO: 987 - protein, 284 aa, Homarus americanus (American lobster); identical to SEQ ID NO: 986

SEQ ID NO: 988 - protein, 150 aa, Homarus americanus (American lobster)
MDSLDAEQLSALQKAFDSFDTDSKGFITPETVGVILRMMGVKISEKNLQEVISETDEDGSGELEFEEFVELAAKFLIEEDEEALKAELREAFRVYDRGGNGYITTDVLKEILRELDNRLTEEDLDSIIEEVDEDGSGTLDFNEFMQMMNG

SEQ ID NO: 989 - protein, 141 aa, Lepidoglyphus destructor (Storage mite)
MMKFIALFALVAVASAGKMTFKDCGHGEVTELDITGCSGDTCVIHRGEKMTLEAKFAANQDTAKVTIKVLAKVAGTTIQVPGLETDGCKFIKCPVKKGEALDFIYSGTIPAITPKVKADVTAELIGDHGVMACGTVHGQVE

SEQ ID NO: 990 - protein, 141 aa, Lepidoglyphus destructor (Storage mite)
MMKFIALFALVAVASAGKMTFKDCGHGEVTELDITGCSGDTCVIHRGEKMTLEAKFAANQDTAKVTIKVLTKVAGTTIQVPGLETDGCKFIKCPVKKGEALDFIYSGTIPAITPKVKADVTAELIGDHGVMACGTVHGQVE

SEQ ID NO: 991 - protein, 141 aa, Lepidoglyphus destructor (Storage mite)
MMKFIALFALVAVASAGKMTFKDCGHGEVTELDISGCSGDTCVIHRGQKMTLDAKFAANQDTNKVTIKVLAKVAGTTIQVPGLETDGCKVLKCPIKKGEALDFNYGMTIPAITPKIKADVTAELVGDHGVMACGTIHGQVE

SEQ ID NO: 992 - protein, 141 aa, Lepidoglyphus destructor (Storage mite)
MMKFIALFALVAVASAGKMTFKDCGHGEVTELDISGCSGDTCVIHRGQKMTLDAKFAANQDTNKVTIKVLAKVAGTTIQVPGLETDGCKVLKCPIKKGEALDFNYGMTIPAITPKIKVDVTAELVGDHGVMACGTIHGQVE

SEQ ID NO: 993 - protein, 110 aa, Lepidoglyphus destructor (Storage mite)
DDFRNEFDRLLIHMTEEQFAKLEQALAHLSHQVTELEKSKSKELKAQILREISIGLDFIDSAKGHFERELKRADLNLAEKFNFESALSTGAVLHKDLTALATKVKAIETK

SEQ ID NO: 994 - protein, 171 aa, Lepidoglyphus destructor (Storage mite)
MTGVKTHLEHELKRTDLNFLEKFNLDEITATLNVLTKELTEVQKHVKAVESDEVDVAIPNPDEFRNEFDRLLIHMTEEQFAKLEQALAHLSHQVTELEKSKSKELKAQILREISIGLDFIDSAKGHFERELKRADLNLAEKFNFESALSTGAVLHKDLTALATKVKAIETK

SEQ ID NO: 995 - protein, 169 aa, Lepidoglyphus destructor (Storage mite)
MTGVKTHLQHELKRTDLNFLEKFNLDEITAPLNVLTKELTEVQKHVKAVESDEVAIPNPDEFRNEFDRLLIHMTEEQFAKLEQALAHLSHQVTELEKSKSKELKAQILREISIGLDFIDSAKGHFERELKRADLNLAEKFNFESALSTGAVLHKDLTALATKVKAIETK

SEQ ID NO: 996 - protein, 216 aa, Lepidoglyphus destructor (Storage mite)
MQYLAIAVIVALAGLSAAAHKPAYYDDNMANQMVDQIVKSLTTKKELDPFKIEQTKVPIDKKIGLIHIKGSATIKNAVITGLSHISRRGDAKIDTDGGAFAATLKLGDKNIRIKTDLHLDLGKIIHPNLKFEGHIGDIDMKLKLKLDAEGKPSLDQFEIDEFEQVELFIHGLGPLDPLVDVIADSFVKYFNPQARKLVTDMLKPILVEEIKKLKLN

SEQ ID NO: 997 - protein, 284 aa, Lepidoglyphus destructor (Storage mite)
MEAIKNKMQAMKLEKDNAIDRAEIAEQKSRDANLRAEKSEEEVRGLQKKIQQIENELDQVQESLTQANTKLEEKEKSLQTAEGDVAALNRRIQLIEEDLERSEGRLKIATSKLEEASQSADESERMRKMLEHRSITDEERMEGLESQLKEARMMAEDADRKYDEVARKLAMVEADLERAEERAETGESKIVELEEELRVVGNNLKSLEVSEEKAQQREEAYEQQIRIMTTKLKEAEARAEFAERSVQKLQKEVDRLEDELVHEKEKYKSISDELDQTFAELTGY

SEQ ID NO: 998 - protein, 131 aa, Lepidoglyphus destructor (Storage mite)
MANIAGQYKLDKSENFDQFLDKLGVGFLVKTAAKTVKPTLEVAVDGDTYIFRSLSTFKNTEIKFKLGEEFEEDRADGKRVKTVIVKDGDNKFVQTQYGDKEVKVVREFKGDEVEVTASVDGVTSVRPYKRA

SEQ ID NO: 999 - protein, 284 aa, Lepisma saccharina (Silverfish)
MEAIKKKMQAMKLEKDNAMDKADALEAQARDANRKADKILEEVQDLKKKPSQVETDFTTTKENLATANKNLEDKEKTLTNTESEVASLNRKVQMIEENLERSEERLGTALTKLGEASHAADEASRMCKVLENRSQQDEERMDQLTNQLKEARMLAEDADGKSDEVSRKMAQVEDDLEVAEDRVKSGDSKIMELEEELKVVGNSLKSLEVSEEKANQRVEEYKRQIKTLTVKLKEAEARAEYAEKYVKKLQKEVDRLEDELGINKDRYRALADEMDQTFAELSGY

SEQ ID NO: 1000 - protein, 24 aa, Liposcelis bostrychophila (Booklouse)
AVLDTALSGIDKVLHGSIDAHKAD

SEQ ID NO: 1001 - protein, 284 aa, Litopenaeus vannamei (White shrimp)
MDAIKKKMQAMKLEKDNAMDRADTLEQQNKEANNRAEKSEEEVHNLQKRMQQLENDLDQVQESLLKANIQLVEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 1002 - protein, 356 aa, Litopenaeus vannamei (White shrimp)
MADAAVIEKLEAGFKKLEAATDCKSLLKKYLTKEVFDKLKDKRTSLGATLLDVIQSGVENLDSGVGIYAPDAEAYTLFAPLFDPIIEDYHVGFKQTDKHPNKDFGDVNSFVNVDPEGKFVISTRVRCGRSLQGYPFNPCLTESQYKEMEAKVSSTLSSLEGELKGTYYPLTGMSKEVQQKLIDDHFLFKEGDRFLQAANACRYWPAGRGIYHNDNKTFLVWVNEEDHLRIISMQMGGDLGQVFRRLTSAVNEIEKRIPFSHHDRLGFLTFCPTNLGTTVRASVHIKLPKLAANREKLEEVAGKYNLQVRGTRGEHTEAEGGIYDISNKRRMGLTEFQAVKEMQDGILELIKIEKEM

SEQ ID NO: 1003 - protein, 177 aa, Litopenaeus vannamei (White shrimp)
MSRKSGSRSSSKRSKKSGGGSNVFDMFTQRQVAEFKEGFQLMDRDKDGVIGKTDLRGTFDEIGRIATDQELDEMLADAPAPINFTMLLNMFAERQTGESDDDDVVAKAFLAFADEEGNIDCDTFRHALMTWGDKFSSQEADDALDQMDIDDGGKIDVQGVIQMLTAGGGDDAAAEEA

SEQ ID NO: 1004 - protein, 193 aa, Litopenaeus vannamei (White shrimp)
MAYSWDNRVKYVVRYMYDIDNNGFLDKNDFECLAVRNTLIEGRGEFSADAYANNQKIMRNLWNEIAELADFNKDGEVTVDEFKQAVQKHCQGKKYGDFPGAFKVFIANQFKAIDVNGDGKVGLDEYRLDCITRSAFAEVKEIDDAYNKLTTEDDRKAGGLTLERYQDLYAQFISNPDESCSACYLFGPLKVVQ

SEQ ID NO: 1005 - protein, 284 aa, Macrobrachium rosenbergii (giant freshwater prawn)
MDAIKKKMQAMKLEKDNAMDRADTLEQQNKEANNRAEKSEEEVHNLQKRMQQLENDLDSVQEALLKANQHLEEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 1006 - protein, 284 aa, Melicertus latisulcatus (King Prawn)
MDAIKKKMQAMKLEKDNAMDRADTLEQQNKEANIRAEKAEDDVNKLQKKLQQLENDFDQVQEALLLANTNAVEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 1007 - protein, 274 aa, Metapenaeus ensis (Shrimp)
MKLEKDNAMDRADTLEQQNKEANNRAEKSEEEVHNLQKRMQQLENDLDQVQESLLKANNQLVEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 1008 - protein, 112 aa, Myrmecia pilosula (Australian jumper ant)
MKLSCLLLTLTIIFVLTIVHAPNVEAKDLADPESEAVGFADAFGEADAVGEADPNAGLGSVFGRLARILGRVIPKVAKKLGPKVAKVLPKVMKEAIPMAVEMAKSQEEQQPQ

SEQ ID NO: 1009 - protein, 75 aa, Myrmecia pilosula (Australian jumper ant)
MKLSCLLLTLAIIFVLTIVHAPNVEAKALADPESDAVGFADAVGEADPIDWKKVDWKKVSKKTCKVMLKACKFLG

SEQ ID NO: 1010 - protein, 84 aa, Myrmecia pilosula (Australian jumper ant)
MKLSCLLLTLAIIFVLTIVHAPNVKAKALADPESDAVGFADAVGEADPFDITKLNIKKLTKATCKVISKGASMCKVLFDKKKQE

SEQ ID NO: 1011 - protein, 199 aa, Pachycondyla chinensis (Asian needle ant)
TEGGAVHTMCQYTSPQPSPNCGTYSNAHITAADKETILKVHNDERQKVKAGQETRGNPGPQPAASNMPDLTWDNELAAIAQRWVNQCKIGHDGCRNVERYQVGQNIAMSGSTAKGPCNMNNLVQMWINEVNALNAADVSSMPSDGNYFMKIGHYTQLVWGKTTKVGCGIIQFLDGKFYKCYLACNYGPAGNMFGAPIYQ

SEQ ID NO: 1012 - protein, 284 aa, Pandalus borealis (Northern shrimp)
MDAIKKKMQAMKLEKDNAMDRADTLEQQNKEANNRAEKSEEEVFGLQKKLQQLENDLDSVQEALLKANQHLEEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 1013 - protein, 274 aa, Panulirus stimpsoni (Spiny lobster)
MKLEKDNAMDRADTLEQQNKEANIRAEKAEEEVHNLQKRMQQLENDLDQVQESLLKANTQLEEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKFVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 1014 - protein, 284 aa, Penaeus aztecus (Brown shrimp); identical to SEQ ID NO: 1001

SEQ ID NO: 1015 - protein, 356 aa, Penaeus monodon (Black tiger shrimp)
MADAAVIEKLEAGFKKLEAATDCKSLLKKYLSKAVFDQLKEKKTSLGATLLDVIQSGVENLDSGVGIYAPDAEAYTLFSPLFDPIIEDYHVGFKQTDKHPNKDFGDVNTFVNVDPEGKYVISTRVRCGRSMEGYPFNPCLTEAQYKEMEAKVSSTLSSLEGELKGTYYPLTGMSKEVQQKLIDDHFLFKEGDRFLQAANACRYWPAGRGIYHNDNKTFLVWVNEEDHLRIISMQMGGDLGQVFRRLTSAVNEIEKRIPFSHHDRLGFLTFCPTNLGTTVRASVHIKLPKLAANREKLEEVAGKYNLQVRGTRGEHTEAEGGIYDISNKRRMGLTEFQAVKEMQDGILELIKMEKEM

SEQ ID NO: 1016 - protein, 176 aa, Penaeus monodon (Black tiger shrimp)
SRKSGSRSSSKRSKKSGGGSNVFDMFTQRQVAEFKEGFQLMDRDKDGVIGKTDLRGTFDEIGRIATDQELDEMLADAPAPINFTMLLNMFAERQTGESDDDDVVAKAFLAFADEGGNIDCDTFRHALMTWGDKFSSQEADDALDQMDIDDAGKIDVQSVIQMLTAGGGDDAAAEEA

SEQ ID NO: 1017 - protein, 150 aa, Penaeus monodon (Black tiger shrimp)
MDSLDEEQIETLRKAFNSFDTEGAGSINAETVGVILRMMGVKISEKNLQEVIAETDEDGSGMLEFEEFAELAAKFLIEEDEEALKAELREAFRIYDKDCQGYITTDILKEILVELDPKLTPTDLEGIIEEVDEDGSGTLDFDEFMEMMSG

SEQ ID NO: 1018 - protein, 231 aa, Periplaneta americana (American cockroach)
EFQSIISTLNAMPEYQELLQNLRDKGVDVDHYIELIRALFGLTRAARNLQDDLNDFLALIPTDQILAIAMDYLANDAEVQELVAYLQSDDFHKIITTIEGLPEFANFYNFLKEHGLDVADFLNEIHSIIGLPPFVPPSRRHARRGVGINGLIDDVIAILPVDELKALFQEKLETSPDFKALYDAIRSPEFQSIISTLNAMPEYQDLLQNLRDKGVDVDHFIELIRSLFGLP

SEQ ID NO: 1019 - protein, 228 aa, Periplaneta americana (American cockroach)
SIISTLNAMPEYQDLLQNLRDKGVDVDHYIELIRALFGLTRAARNLQDDLNDFLALIPTDQILAIAMDYLANDAEVQELVAYLQSDDFHKIITTIEGLPEFANFYNFLKEHGLDVADFLNEIHSIIGLPPFVPPSRRHARRGVGINGLIDDVIAILPVDELKALFDEKLETSPDFKALYDAIRSPEFQSIISTLNAMPEYQDLLQNLRDKGVDVDHFIELIRSLFGLP

SEQ ID NO: 1020 - protein, 395 aa, Periplaneta americana (American cockroach)
MKLPIMILAVLGVAFGKSLPNRNLQDDLNDFLALLPVDEITAIVMDYLANDAEVQEAVAYLQGEEFHKIVFTVEGLQEFGNFVQFLEDHGLDAVGYINRLHSVFGWDPYVPSSKRKHTRRGVGVDGLIDDIIAILPIDDLKALFQEKLETSPDFKAFYDAVRSPEFQSIVQTLNAMPEYQDLLQKLRDKGVDVDHYIELIRALFGLTRAARNLQDDLNDFLALIPTDQILAIAMDYLANDAEVQELVAYLQSDDFHKIINTIEALPEFANFYNFLKGHGLDVADYINEIHSIIGLPPFVPPSRRHARRGVGINGLIDDVIAILPVDELKALFQEKLETSPDFKALYDAIRSPEFQSIISTLNAMPEYQELLQNLRDKAVDVDHFIELIRSLFGLP

SEQ ID NO: 1021 - protein, 274 aa, Periplaneta americana (American cockroach)
VGVDGLIDDIIAILPIDDLKALFQEKLETSLDFKAFYDAVRSPEFQSIVQTLNAMPEYQDLLQKLRDKGVDVDHYIELIRALFGLTREARNLQDDLNDFLALIPTDQILAIAMDYLANDAEVQELVAYLQSDDFHKIINTIEALPEFANFYNFLKGHGLDVANYINEIHSIIGLPPFVPPSRRHARRGVGINGLIDDVIAILPVDELKTLFQEKLETSPDFKALYDAIRSPEFQSIISTLNAMPEYQELLQNLRDKGVDVDHFIELIRSWFGLP

SEQ ID NO: 1022 - protein, 446 aa, Periplaneta americana (American cockroach)
INEIHSIIGLPPFVPPSRRHARRGVGINGLIDDVIAILPVDELKALFQEKLETSPDFKALYDAIRSPEFQSIISTLNAMQRSEHHQNLRDKGVDVDHFIQLIRALFGLSRAARNLQDDLNDFLHSLEPISPRHRHGLPRQRRRSARVSAYLHADDFHKIITTIEALPEFANFYNFLKEHGLDVVDYINEIHSIIGLPPFVPPSRRHARRGVGINGLIDDVIAILPVDELKALFQEKLETSPDFKALYDAIRSPEFQSIISTLNAMPEYQELLQNLRDKGVDVDHFIRVDQGTLRTLSSGQRNLQDDLNDFLALIPTDQILAIAMDYLANDAEVQELVAYLQSDDFHKIITTIEALPEFANFYNFLKEHGLDVVDYINEIHSIIGLPPFVPPSQRHARRGVGINGLIDDVIAILPVDELKALFQEKLETSPDFKALYDAIDLRSSRA

SEQ ID NO: 1023 - protein, 351 aa, Periplaneta americana (American cockroach)
MTFLIQSAFVALAAISAVLCDPVVVPLQKRAPVEEYINTQYVGPVQLGNQYFLCVFDTSSYTTVIPSASCVSGGCNCANVHKYYSNKPVSNNVASVRILGSGYANGSEAHDYIAVSTLNATNQGFLLADDISNDICSLGADCVIGLGRPKSGRAAFNLPTVMENFVNQDNIANSFSFHHGRYPDGQHRGVLVLGGTIPAYYRGDFTYVPLVDKDTWNFKVDSISVGNEVVATDQLAFVDSSKYVITGPAEEIKKINDRLGCTNKVIGSRTLCVFDCDKLDNVPSVTFTIGGVAFNISSTYHIQQNGDLCYSGFQYSAGKCFHFGDFFMDNYYAKFDGQNKRMGFAKSVEEL

SEQ ID NO: 1024 - protein, 685 aa, Periplaneta americana (American cockroach)
MKTALVFAAVVAFVAARFPDHKDYKQLADKQFLAKQRDVLRLFHRVHQHNILNDQVEVGIPMTSKQTSATTVPPSGEAVHGVLQEGHARPRGEPFSVNYEKHREQAIMLYDLLYFANDYDTFYKTACWARDRVNEGMFMYSFSIAVFHRDDMQGVMLPPPYEVYPYLFVDHDVIHMAQKYWMKNAGSGEHHSHVIPVNFTLRTQDHLLAYFTSDVNLNAFNTYYRYYYPSWYNTTLYGHNIDRRGEQFYYTYKQIYARYFLERLSNDLPDVYPFYYSKPVKSAYNPNLRYHNGEEMPVRPSNMYVTNFDLYYIADIKNYEKRVEDAIDFGYAFDEHMKPHSLYHDVHGMEYLADMIEGNMDSPNFYFYGSIYHMYHSMIGHIVDPYHKMGLAPSLEHPETVLRDPVFYQLWKRVDHLFQKYKNRLPRYTHDELAFEGVKVENVDVGKLYTYFEQYDMSLDMAVYVNNVDQISNVDVQLAVRLNHKPFTYNIEVSSDKAQDVYVAVFLGPKYDYLGREYDLNDRRHYFVEMDRFPYHVGAGKTVIERNSHDSNIIAPERDSYRTFYKKVQEAYEGKSQYYVDKGHNYCGYPENLLIPKGKKGGQAYTFYVIVTPYVKQDEHDFEPYNYKAFSYCGVGSERKYPDNKPLGYPFDRKIYSNDFYTPNMYFKDVIIFHKKYDEVGVQGH

SEQ ID NO: 1025 - protein, 631 aa, Periplaneta americana (American cockroach)
DIGDHYDIEANIGHYKYPHVVKNFISYYKKGLLPRGEPFSVYYEKHREQAIKLFELFFAANDYDTFYKTACWARDRVNEGMFMYALTVAAFHREDTKDLVLPPPYEVNPYLFVEDDVIQQAYKYWTKESGTDKHVEHVIPVNFTARSQEDLVAYFREDVDLNAFNMYFRYIYPSWFNTTLYGKSFDRRGEQFYYTYHQIYARYFLERLSNSLPDVKPFQYSKPLKTGYNPHLRYHNGEEMPARPSNMYPTNFDLFYVSDIKNYERRVEKAIDFGYAFDEHRTPYSLYHDQHGMDYLGQMIEGTRNSPHQYFYGSVFHFYRLLVGHVVDPYHKNGLAPSALEHPQTALRDPAFYQLWKRIDHIVQKYKNRLPRYTYDELSFPGVKIENVDVGKLYTYFEHFEHSLGNAMYLGKLEDYMKASIRARHYRLNHKPFTYNIEVSSDKAQDVYVRIFLGPKYDSLGHECELDERRHYFVEMDRFVHKVEAGKTVIERKSHDSSIISDSHDSYRNLFKKVSDALQEKDQYYIDKSHKYCGYPENLLLPKGKKGGQTFTFYVIVTPYVKQDEHDFEPYHYKAFSYCGVGHGRKYPDDKPLGFPFDRKIHDYDFYTPNMYFKDVVIFHKKYDEVHDVTH

SEQ ID NO: 1026 - protein, 470 aa, Periplaneta americana (American cockroach)
LNAFNMYFRYIYPTWFNTTLYGKTFDRRGEQFYYTYHQIYARYFLERLSNSLPDVKPFQYSKPLKTGYNPHLRYQNGEEMPARPSNMYPTNIDLFYVSDIKNYESRVEKAIDFDAFDEHRTPYSLYHDQHGMDYLGQMIEGTSNSPYQYFYGSIFHFYRLLVGHVVDPYHKNGLAPSALEHHQTALRDPAFYQLWKRIDHIVQKYKNRLPRYTYDELSFPGVKIENVDVGKLYTYFEHFEHSLGNAMYLGKLEDVLKANIRARHYRLNHKPFTYNIEVSSDKAQDVYVRIFLGPKYDSLGHECELDERRHYFVEMDRFVHKVEAGKTVIERKSHDSSIISDSHDSYRNLFKKVSDALEGKDQYYIDNSHKYCGYPENLLLPKGKKGGQTFTFYVIVTPYVKQDEHDLESYHYKAFTYCGVGHGRKYPDDKPLGFPFDRKIHDYDFYTPNMYFKDVVIFHKKYDEVHNETN

SEQ ID NO: 1027 - protein, 393 aa, Periplaneta americana (American cockroach)
EMPARPSNMYPTNIDLFYVSDIKNYESRVEKAIDFGYAFDEHRTPYSLYHDQHGMDYLGQMIEGTSNSPYQYFYGSIFHFYRLLVGHVVDPYHKNGLAPSALEHHQTALRDPAFYQLWKRIDHIVQKYKNRLPRYTYDELSFPGVKIENVDVGKLYTYFEHFEHSLGNAMYIGKLEDLLKANIRASHYRLNHKPFTYNIEVSSDKAQDVYVRIFLGPKYDSLGHECELDERRHYFVEMDRFVHKVEAGKTVIERKSHDSSIISDSHDSYRNLYKKVADALEEKDQYYIDKSHKYCNYPENLLLPKGKKGGQTFTFYVIVTPYVKQEQHDFEPYHYKAFSYCGVGHGRKYPDDKPLGFPFDRKIHDYDFYTPNMYFKDVVIFHKKYDEVHEVTH

SEQ ID NO: 1028 - protein, 151 aa, Periplaneta americana (American cockroach)
MDELPDEQIQLLKKAFDAFDREKNGFISTDMVGTILEMLGHPLDDDMLEEIIAEVDADGSGELEFQEFVTLAARFLVEEDAEAMQQELKEAFRLYDKEGNGYITTTVLREILKELDDKLTNEDLDAMIEEIDSDGSGTVDFDEFMEVMTGE

SEQ ID NO: 1029 - protein, 284 aa, Periplaneta americana (American cockroach)
MDAIKKKMQAMKLEKDNAMDCALLCEQQARDANLRAEKAEEEARSLQKKIQQIENDLDQTMEQLMQVNAKLDEKDKALQNAESEVAALNRRIQLLEEDLERSEERLATATAKLAEASQAVDESERARKILESKGLADEERMDALENQLKEARFMAEEADKKYDEVARKLAMVEADLERAEERAESGESKIVELEEELRVVGNNLKSLEVSEEKANLREEEYKQQIKTLTTRLKEAEARAEFAERSVQKLQKEVDRLEDELVHEKEKYKFICDDLDMTFTELAGY

SEQ ID NO: 1030 - protein, 356 aa, Periplaneta americana (American cockroach)
MVDAAVLEKLEAGFAKLAASDSKSLLKKYLTKEVFDNLKTKKTPSFGSTLLDVIQSGLENHDSGVGIYAPDAEAYAVFADLFDPIIEDYHGGFKKTDKHPPKDWGDVDTLGNLDPAGEYIISTRVRCGRSMQGYPFNPCLTEAQYKEMEDKVSSTLSGLEAEPKGQFYLLTGMTKEVQQKLIDDHFLFKEGDRFLQAANACRFWPTGRGIYHNDAKTFLVWCNEEDHLRIISMQMGGDLGQVYRRLVTAVNDIEKRIPFSHDDRLGFLTFCPTNLGTTVRASVHIKVPKLAADKAKLEEVAGKYNLQVRGTRGEHTEAEGGVYDISNKRRMGLTEYDAVKEMNDGIAELIKLESSL

SEQ ID NO: 1031 - protein, 256 aa, Periplaneta americana (American cockroach)
MLRYLVLASLIACSLSAVPKAKRPRLDGRIVGGRPADIADYPYQLSFEYYGSHMCGASIISPNWVVTAAHCVDGVSASSATFRAGGSIRESGGSVHQATQLIANPNYDYYTIDFDVAVARVSPAFSYGTGVQPIPLASSEPSAGQIATVSGWGTTSEGGSTLPSQLQVVSVPIVSRSECNQAYSDYGGITDDMICAAEQQGGKDACQGDSGGPLVVNGQLAGIVSWGVGCAEQGYPGVYSNVASLKGFITEQTGVN

SEQ ID NO: 1032 - protein, 494 aa, Periplaneta americana (American cockroach)
MKLFALLALVVLLAGVQSQKDPKLVPDESTLLRLFEWKFDDIADECERFLAPKGYAGVQVSPVHKNLLYTATAPGLWERYQPMSYKLVSRSGDETAFRDMVRRCNAVGVRIYVDVVLNHMSGNWDNAVGTGGSTADTYNYSYPGVPYDHSDFHPYCILNDYQDPEIVRNCELVGLHDLDQSQDYVREKLIDFLNHLVDAGVAGFRVDAAKHMWPADLEYIYGKVNNRNSDAGYCGDSSPSRYQEVIDLGGEAVSKFEYNGFGRVTEFKHSEQIGYAFRGNNRLEWTYTYKPNWGLLPSGDALVFVDNHDNQRGGGNAILTYKTPKNYKMAIAFILAHPYGYPRVMSSFDFEAHDQGPPQDSDKNILSPSINADGTCGNGWVCEHRWRQHANMVGFRNAVRGTEITNWWDNGNHQIGFCRGDRGFVAFNVEDNDLKQTLQTCLPAGTYCDVISGSKNNRAHLGAELVVAPNGEAFSVRLISDDDGVLAIHLEEKL

SEQ ID NO: 1033 - protein, 407 aa, Periplaneta americana (American cockroach)
MKLTSLVAVGVGVFLAAALQTCKGFIRDFKTHRQLQEKGDDRAVFCYYGSWATYRWGIATFEVDNIDTRLCTHIVYAFTGLRDGVIVSLDEYNDYEENWGKGLMKKFTTLAKNNGIKALVGLGGWNEGSVKYSEMAATQAGRETFADSAVAFLQKQGFDGLDLDWEYPARRGGVPEDKDNFTLLLKTLSEKLHARGLILTVAVSADPKTAANAYDFPNVAKYADYITLMSFDYHTPSSDTVTGLNSPLDSLPQDTGYNKKLNVKYSVNQWLKGGVPPNKLVLGVPLYGRTYRLADPDQHGLGAPILGPGTAGLYTQEAGFLAYYEICSNPDWNVVWNDTSSYLYAYKDYQWLSYDDPNTITIKAQWVLEKNLGGVMVWSLESDDFHGNCGKGAYPLLTAVNKALGRL

SEQ ID NO: 1034 - protein, 355 aa, Plodia interpunctella (Indianmeal moth)
MVDAATLEKLEAGFSKLAASDSKSLLKKYLTREVFDALKNKKTSFGSTLLDSIQSGVENLHSGVGIYAPDAEAYVVFADLFDPIIEDYHNGFKKTDKHPPKNWGDVETLGNLDPAGEFVVSTRVRCGRSMEGYPFNPCLTEAQYKEMEEKVSSTLSGLEGELKGTFFPLTGMSKETQQQLIDDHFLFKEGDRFLQAANACRFWPSGRGIYHNENKTFLVWCNEEDHLRLISMQMGGDLKQVYKRLVRGVNDIAKRIPFSHNERLGFLTFCPTNLGTTVRASVHIKLPKLAADKAKLEEVASKYHLQVRGTRGEHTEAEGGVYDISNKRRMGLTEYEAVKEMYDGIAELIKIEKSL

SEQ ID NO: 1035 - protein, 106 aa, Plodia interpunctella (Indianmeal moth)
MSIHIKDVEDLTARLTEAGDKLVVIDFMATWCGPCKIIGPKLDEIAAEMADSIVVVKVDVDECEDIATEYSINTMPTFVFVKNGKPVEQFSGANVEKLRSTILKLK

SEQ ID NO: 1036 - protein, 301 aa, Polistes annularis (Wasp)
MSPDCTFNEKDIVFYVYSRDKRDGIILKKETLTNYDLFTKSTISKQVVFLIHGFLSTGNNENFVAMSKALIEKDDFLVISVDWKKGACNAFASTKDALGYSKAVGNTRHVGKFVADFTKLLVEKYKVLISNIRLIGHSLGAHTSGFAGKEVQKLKLGKYKEIIGLDPAGPYFHRSDCPDRLCVTDAEYVQVIHTSIILGVYYNVGSVDFYVNYGKNQPGCNEPSCSHTKAVKYLTECIKHECCLIGTPWKKYFSTPKPISQCRGDTCVCVGLNAKSYPARGAFYAPVEANAPYCHNEGIKL

SEQ ID NO: 1037 - protein, 367 aa, Polistes annularis (Wasp)
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 1038 - protein, 209 aa, Polistes annularis (Wasp)
SSQGVDYCKIKCPSGIHTVCQYGESTKPSKNCAGKVIKSVGPTEEEKKLIVSEHNRFRQKVAQGLETRGNPGPQPAASDMNDLVWNDELAHIAQVWASQCQFLVHDKCRNTAKYPVGQNIAYAGGSNLPDVVSLIKLWENEVKDFNYNTGITKQNFAKIGHYTQMVWGKTKEIGCGSLKYMENNMQNHYLICNYGPAGNYLGQLPYTKK

SEQ ID NO: 1039 - protein, 337 aa, Polistes dominulus (Mediterranean paper wasp)
MNFKYSILFICFVKVLDNCYAADDLTTLRNGTLDRGITPDCTFNEKDIELHVYSRDKRNGIILKKEILKNYDLFQKSQISHQIAILIHGFLSTGNNENFDAMAKALIEIDNFLVISVDWKKGACNAFASTNDVLGYSQAVGNTRHVGKYVADFTKLLVEQYKVPMSNIRLIGHSLGAHTSGFAGKEVQRLKLGKYKEIIGLDPAGPSFLTNKCPNRLCETDAEYVQAIHTSAILGVYYNVGSVDFYVNYGKSQPGCSEPSCSHTKAVKYLTECIKRECCLIGTPWKSYFSTPKPISQCKRDTCVCVGLNAQSYPAKGSFYVPVDKDAPYCHNEGIKL

SEQ ID NO: 1040 - protein, 316 aa, Polistes dominulus (Mediterranean paper wasp)
ADDLTTLRNGTLDRGITPDCTFNEKDIELHVYSRDKRNGIILKKEILKNYDLFQKSQISHQIAILIHGFLSTGNNENFDAMAKALIEIDNFLVISVDWKKGACNAFASTNDVLGYSQAVGNTRHVGKYVADFTKLLVEQYKVPMSNIRLIGHSLGAHTSGFAGKEVQRLKLGKYKEIIGLDPAGPSFLTNKCPNRLCETDAEYVQAIHTSAILGVYYNVGSVDFYVNYGKSQPGCSEPSCSHTKAVKYLTECIKRECCLIGTPWKSYFSTPKPISQCKRDTCVCVGLNAQSYPAKGSFYVPVEKDAPYCHNEGIKL

SEQ ID NO: 1041 - protein, 316 aa, Polistes dominulus (Mediterranean paper wasp)
ADDLTTLRNGTLDRGITPDCTFNEKDIELHVYSRDKRNGIILKKEILKNYDLFQKSQISHQIAILIHGFLSTGNNENFDAMAKALIEIDNFLVISVDWKKGACNAFASTNDVLGYSQAVGNTRHVGKYVADFTKLLVEQYKVPMSNIRLIGHSLGAHTSGFAGKEVQRLKLGKYKEIIGLDPAGPSFLTSKCPDRLCETDAEYVQAIHTSAILGVYYNVGSVDFYVNYGKSQPGCSEPSCSHTKAVKYLTECIKRECCLIGTPWKSYFSTPKPISQCKRDTCVCVGLNAQSYPAKGSFYVPVDKDAPYCHNEGIKL

SEQ ID NO: 1042 - protein, 316 aa, Polistes dominulus (Mediterranean paper wasp)
ADDLTTLRNGTLDRGITPDCTFNEKDIELHVYSRDKRNGIILKKEILKNYDLFQKSQISHQIAILIHGFLSTGNNENFDAMAKALIEIDNFLVISVDWKKGACNAFASTNDVLGYSQAVGNTRHVGKYVADFTKLLVEQYKVPMSNIRLIGHSLGAHTSGFAGKEVQRLKLGKYKEIIGLDPAGPSFLTSKCPDRLCETDAEYVQAIHTSAILGVYYNVGSVDFYVNYGKSQPGCSEPSCSHTKAVKYLTECIKRECCLIGTPWKSYFSTPKSISQCKRDTCVCVGLNAQSYPAKGSFYVPVEKDAPYCHNEGIKL

SEQ ID NO: 1043 - protein, 277 aa, Polistes dominulus (Mediterranean paper wasp)
MNCGKIILLFITIIGVAKSREENCKCGWDNPSRIVNGVETEINEFPMVARLIYPSPGMYCGGTIITPQHIVTAAHCLQKYKRTNYTGIHVVVGEHDYTTDTETNVTKRYTIAEVTIHPNYNSHNNDIAIVKTNERFEYSMKVGPVCLPFNYMTRNLTNETVTALGWGKLRYNGQNSKVLRKVDLHVITREQCETHYGAAIANANLLCTFDVGRDACQNDSGGPILWRSPTTDNLILVGVVNFGRTCADDAPGGNARVTSFMEFIHNATIGETYCKAD

SEQ ID NO: 1044 - protein, 227 aa, Polistes dominulus (Mediterranean paper wasp)
MKISCLICLVIVLTIIHLSQANDYCKIKCSSGVHTVCQYGESTKPSKNCAGKLIKSVGPTEEEKKLIVEEHNRFRQKVAKGLETRGNPGPQPAASNMNNLVWNDELAKIAQVWASQCQILVHDKCRNTEKYQVGQNIAYAGSSNHFPSVTKLIQLWENEVKDFNYNTGITNKNFGKVGHYTQMVWGNTKEVGCGSLKYVEKNMQIHYLICNYGPAGNYLGQPIYTKK

SEQ ID NO: 1045 - protein, 226 aa, Polistes exclamans (Wasp)
MEIGGLVYLVIVVAIIHSSQGVDYCKIRCPSGIHTVCQYGESTKPSKNCAGKVIKSVGPTEEEKKLIVSEHNRFRQKVAQGLETRGNPGPQPAASDMNDLVWNDELAHIAQVWASQCQFLVHDKCRNTAKYPVGQNIAYAGGSKLPDVVSLIKLWENEVKDFNYNTGITKQNFAKIGHYTQMVWGKTKEIGCGSLKYMENKMQNHYLICNYGPAGNYLGQLPNTKK

SEQ ID NO: 1046 - protein, 205 aa, Polistes fuscatus (Wasp)
VDYCKIKCSSGIHTVCQYGESTKPSKNCADKVIKSVGPTEEEKKLIVNEHNRFRQKVAQGLETRGNPGPQPAASDMNNLVWNDELAHIAQVWASQCQILVHDKCRNTAKYQVGQNIAYAGGSKLPDVVSLIKLWENEVKDFNYNKGITKQNFGKVGHYTQMIWAKTKEIGCGSLKYMKNNMQHHYLICNYGPAGNYLGQLPYTKK

SEQ ID NO: 1047 - protein, 42 aa, Polistes gallicus (Wasp)
GITPDCTFNEKDIELHVYSRDKRNGIILKKEILKNYDLFKES

SEQ ID NO: 1048 - protein, 206 aa, Polistes gallicus (Wasp)
NDYCKIKCSSGVHTVCQYGESTKPSKNCAGKVIKSVGPTEEEKKLIVEEHNRFRQKVAQGLETRGNPGPQPAASNMNNLVWNDEQAKIAQVWASQCQILVHDKCRNTEKYQVGQNIAYAGSSNHFPSVTKLIQLWENEVKDFNYNTGITNKNFGKVGHYTQMVWGNTKEVGCGSLKYVEKNMKIHYLICNYGPAGNYLGQPIYTKK

SEQ ID NO: 1049 - protein, 322 aa, Polybia paulista (Wasp)
MNFKYSILFICFGTLDRGLIPECPFNEYDILFFVYTRQQRDGIVLTEETLQNYDLFKKSTISRQVVFIDHGFLSNGNNENFIAMAKALIEKDNFLVISVDWKKGACNAFASTLDYLGYSTAVGNTRHVGKYVADFTKLLVEQYKVSMSNIRLIGHSLGAHTSGFAGKEVQELKLNKYSNIDGLDPAGPSFDSNDCPERLCETDAEYVQIIHTSNILGVYSKIGTVDFYMNYGSHQPGCGRFFSPSCSHTKAVKYLTECIKHECCLIGTPWKKYFSTPKPISQCTKDTCVCVGLNAKSYPARGSFYVPVEATAPYCHNEGIKL

SEQ ID NO: 1050 - protein, 288 aa, Polybia paulista (Wasp)
GETISIYYDPGKFPALMPLKNGNYEERNGGVPQRGNITIHLQQFNEDLDKMTPDKNFGGIGVIDFERWKPIFRQNWGNTEIHKKYSIELVRYEHPKWSESMIEAEATKKFEKYARLFMEETLKLAKKTRKRAKWGYYGFPYCYNYTPNNPGPDCDAKAMIENDRLSWMYNNQEILFPSVYVRHELTPDQRVYLVQGRIKEAVRISNNLKHSPKVLSYWWYVYQDKMDIFLSETDVKKTFQEIVTNGGDGIIIWGSSSDVNSLSKCKRLREYLLNTLGPFAVNVTETVN

SEQ ID NO: 1051 - protein, 207 aa, Polybia paulista (Wasp)
NKYCNIKCSKVAHTVCQTGESTKPSSKNCAKVSITSVGVTEEEKKLIVDEHNRFRQKVAQGLETRGNPGPQPAASDMNNLVWNDELAYIAQVWASQCQFFVHDKCRNTAQYQVGQNIAYSASTAAYPGVVKLIVLWENEVKDFNYNTGITKENFAKVGHYTQVVWAKTKEVGCGSIKYIEKGMKSHYLVCNYGPAGNVLGAQIYEIK

SEQ ID NO: 1052 - protein, 192 aa, tastacus leptodactylus (Narrow?clawed crayfish)
AYSWDNRVKYVVRYMYDIDNNGFLDKNDFECLALRNTLIEGRGEFNEAAYANNQKIMSNLWNEIAELADFNKDGEVTIDEFKKAVQNVCVGKAFATFPAAFKVFIANQFKTVDVNGDGLVGVDEYRLDCISRSAFANIKEIDDAYNKLATDADKKAGGISLARYQELYAQFISNPDESANAVYLFGPLKEVQ

SEQ ID NO: 1053 - protein, 201 aa, tastacus leptodactylus (Narrow?clawed crayfish)
ADKAKAAEEAKKKQDDIDRKKAEVRKRLEEQSLKKQKKGFMTPERKKKLRLLLRKKAAEELKKEQERKAGERRKIIDQRCGQPKNLDGANEEQLRAIIKEYFDHTAQIESDKYDVELEIIRKDYEINELNIQVNDLRGKFIKPTLKKVSKYENKFAKLQKKAAEFNFRNQLKTVKKKEFELEDDKGATEGDGPAAEEVAAE

SEQ ID NO: 1054 - protein, 284 aa, Portunus pelagicus (Blue swimmer crab)
MDAIKKKMQAMKLEKDDAMDRADTLEQQNKEANIRAEKAEEEVHNLQKRMQQLENDLDQVQESLLKANTQLEEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSTTDELDQAFSELSGY

SEQ ID NO: 1055 - protein, 137 aa, Solenopsis geminata (Tropical fire ant)
MKTFVLVSCLLVFTQIIYAVDIKELKIMNRILEKCIRTVPKGENDPINPLKNVNVLYCAFSKRGIFTPKGVNTKQYINYCEKTIINPADIKQCKKLISKCIKKVYDRPGPIIERSKNLLSCVLKKGVLELTVYGKKK

SEQ ID NO: 1056 - protein, 346 aa, Solenopsis invicta (Red imported fire ant)
MRKFAAIFVVFFVQCTHLYSLAQARAEPDPGVVEYLKQSCVYGNSSYINVYLYNSRFQGKNLGNQQSCQDINASLPVVFITHGFTSSAQVSTFKDLANAFVQKGHTAFIVDWSEAACTDGLPGVQFAEYNAAASNTYDIGQLMAKYTVDLMNKCKIPLNNIQYVGHSLGSHVCGFAAKHVKKLINKTMPYILALDPADPSFGSNKCGERICKSDAKRIVVFKTSILGIGENIIGHLLIVFDGGKSQPACSWYDVPCSHSESIVYATGMVSGRCQHLAVPWTAQQRINPIQWKFWRVFTSNIPAYPTSDTTNCVVLNTNVFKNDNTFEGEYHAFPDCARNLFKCRQQ

SEQ ID NO: 1057 - protein, 138 aa, Solenopsis invicta (Red imported fire ant)
MKSFVLATCLLGFAQIIYADNKELKIIRKDVAECLRTLPKCGNQPDDPLARVDVWHCAMAKRGVYDNPDPAVIKERSMKMCTKIITDPANVENCKKVASRCVDRETQGPKSNRQKAVNIIGCALRAGVAETTVLARKK

SEQ ID NO: 1058 - protein, 234 aa, Solenopsis invicta (Red imported fire ant)
MELIVSILWLAITAENLANTLATNYCNLQSCKRNNAIHTMCQYTSPTPGPMCLEYSNVGFTDAEKDAIVNKHNELRQRVASGKEMRGTNGPQPPAVKMPNLTWDPELATIAQRWANQCTFEHDACRNVERFAVGQNIAATSSSGKNKSTPNEMILLWYNEVKDFDNRWISSFPSDDNILMKVGHYTQIVWAKTTKIGCGRIMFKEPDNWTKHYLVCNYGPAGNVLGAPIYEIKK

SEQ ID NO: 1059 - protein, 137 aa, Solenopsis invicta (Red imported fire ant)
MKTFVLVSCLLVFTQIIYALDIKEISIMNRILEKCIRTVPKRENDPINPLRNVNVWYCAFTKRGIFTPKGVNTKQYINYCEKTAISPADIKLCKKIASKCVKKVYDRPGPIIERSKNLLSCVLKKGLLELTVYGKKK

SEQ ID NO: 1060 - protein, 119 aa, Solenopsis richteri (Black fire ant)
DIEAQRVLRKDIAECARTLPKCVNQPDDPLARVDVWHCAMSKRGVYDNPDPAVVKEKNSKMCPKIITDPADVENCKKVVSRCVDRETQRPRSNRQKAINITGCILRAGVVEATVLAREK

SEQ ID NO: 1061 - protein, 211 aa, Solenopsis richteri (Black fire ant)
TNYCNLQSCKRNNAIHTMCQYTSPTPGPMCLEYSNVGFTDAEKDAIVNKHNELRQRVASGKEMRGTNGPQPPAVKMPNLTWDPELATIAQRWANQCTFEHDACRNVERFAVGQNIAATSSSGKNKSTLSDMILLWYNEVKDFDNRWISSFPSDGNILMHVGHYTQIVWAKTKKIGCGRIMFKEDNWNKHYLVCNYGPAGNVLGAQIYEIKK

SEQ ID NO: 1062 - protein, 138 aa, Solenopsis saevissima (Brazilian fire ant)
MKSFVLATCLLGFAQIIYADTEKLKILRKDIAKCARTLPKCVNQPDDPLARVDVWHCALAKSGVFDDPDPAAIKKKYKKFCAIAVTDPANVENCKKVTSRCVDKETQCSKSNRQKAINIAACILRSGVTETTVLAREK

SEQ ID NO: 1063 - protein, 554 aa, Tabanus yao (Horsefly)
MFKITVFIYVLQLILPSKVHSSPVPDSDNGLREFPLSIVHINDFHARFEQTDELGGQCKPTAKCVGGYARLVTTVKKLKEEGQNTIFLNAADNYQGTLWYNLGKWNVTAYFMNLLPADAMTLGNHEFDDKIEGIVPFLEVIKTPIVVANIDDSLEPTFKGKYTKSVVLERGGRKIGIVGVIAQNTDNISSPGKLRFLDEIQSVKNESKRLREEEKVDIVIVLSHIGLDHDYDLAEQAGDYIDAIIGGHSHSFLWTGDNPPGKEKVVDAYPVEIVQTSGKKVLIVQASAFARYVGNITLYFGENNNLIRYAGAPVYLDSDVPEVPQIVEEMKAWEEFVHEKGNEIIAESRVVLSRENCRVSDCNIGNFFTDAYVHEYVTSHTGPYWTPVSVGLMNVGGIRASVDRGNITFSQLITMAPFENTVDTFDLSGKHLLEAFEHAVTVPNRLGFNGQNMLQVSGVKLVYDVTKCEGQRVVSAKIRCQKCDIPKYEPLDPEETYRIVTASFLANGGDGFTMIRDNKKNYKVGRKDYDVLINYAKYSSPITIGEEGRIRIIQ

SEQ ID NO: 1064 - protein, 349 aa, Tabanus yao (Horsefly)
MKLHQGLVCLSVLILLPTCILGDRKFEVYWNIPTFMCPDQNKTIMDLNKKHGVIQNTEDLFRGDKISLLYHPGAFPAITRNKTTNTLIYENGGVPQAGNLSLHLKLLEKDINEQITDKNFSGLAVIDFELWRPIFRQNGGSLSDYQNLSLKLEKDLHPEFNEDQLRKEAERRIEKFGRSFIKQTLIKAKKLRPKAQWGYYAFPYCFNGRRRYVDTCIPSAKIDNDRILYMFENSDVIYPAVYLQTDLAQKNQTGLVKGRVDEAVRMAKMVKKPAKPPVLVYHRYVFTDTLEYISKENTTAVFKAMKDNGADGVIIWGSSFDLNSKEKCAKFLDYLREVLWPVIDEVKRS

SEQ ID NO: 1065 - protein, 256 aa, Tabanus yao (Horsefly)
MAPIIVPCLLLVVLVLQCSVINSLDYCSLCRGGRGEHVGCGSPGFSSDCGQKARTRKFTKEHKKVILDKINDVRDHVAKGSWGLPVASRMKVIVWDEELAALAKRHTQGCVPEAYKCRHTLRFWSPGQLNFEFYADKMPSTMSLISTAIKRGHTQKHNITRDIIEKYQPAGPKGNVKELALAISDRVTAVGCGLTTWKLGGKARALLTCNFSSENDYNRPVYKTGNSPGEKCIKKDETFKNLCSAQEPINPNEHNF

SEQ ID NO: 1066 - protein, 18 aa, Thaumetopoea pityocampa (Pine processionary moth)
GETYSDKYDTIDVNEVLQ

SEQ ID NO: 1067 - protein, 115 aa, Thaumetopoea pityocampa (Pine processionary moth)
MKLLIFAILIALSSSVPQLSEKAEEAVDLAYQEKNNLFDLGSVAGDILSRSGCHVSFGCHKGYCWAGCGDPTNPWSWGENWCYTTKSYSQSYSYVQCTQDSECDGCWKCGGPCSA

SEQ ID NO: 1068 - protein, 169 aa, Triatoma protracta (California kissing bug)
  misc_feature (39)..(39): Xaa can be any naturally occurring amino acid
  misc_feature (49)..(49): Xaa can be any naturally occurring amino acid
  misc_feature (77)..(77): Xaa can be any naturally occurring amino acid
  misc_feature (100)..(100): Xaa can be any naturally occurring amino acid
  misc_feature (130)..(130): Xaa can be any naturally occurring amino acid
MKTFIVITFIGILSYAYADECENPEPMQGFSASQFYQGXWYVTHETSAXTLSECNILTTSNDNGKFTVKHKYTKDGXVGELICEGQASANNKFTYDCKFXGZTMEQVTRTAMDTDYNDYALYYLCTTYKXGPNAGKKEGHYILSRRQPNTEIPDALKTKTKDLNLKLCG

SEQ ID NO: 1069 - protein, 141 aa, Tyrophagus putrescentiae (Storage mite)
MKFLILFALVAVAAAGQVKFTDCGKKEIASVAVDGCEGDLCVIHKSKPVHVIAEFTANQDTCKIEVKVTGQLNGLEVPIPGIETDGCKVLKCPLKKGTKYTMNYSVNVPSVVPNIKTVVKLLATGEHGVLACGAVNTDVKP

SEQ ID NO: 1070 - protein, 285 aa, Tyrophagus putrescentiae (Storage mite)
MKILLFLCFLVSVAFAKPPTIQLKSNTKSQNGFIVGGTEAVDGDAPHQVSLQHTSHFCGGSIISERWILTAAHCIDADDLSNPGGMSVRYNTLNLKSGTLVKVKSIKVHEQYSNVTSDNDIALLETVASMNLNQTNAVAAKLPAKGNDPQDGDLFLSGWGTLHSGDTTIPTNLQKVTVPLTNRSVCAEAYTGIVNITENMFCAGKMGIGGVDSCQGDSGGGAMLNKELVGVVSFGVGCGDPKYPGVYTRVSQYLDWIELSAKSSATTLVAVNITLFLTLFIGAIW

SEQ ID NO: 1071 - protein, 284 aa, Tyrophagus putrescentiae (Storage mite)
MDAIKNKMQAMKLEEDNAIDRAEIAEQKARDANLKSEKTEEEVRALQKKIQQIENELDQVQENLTQATTKLEEKEKALQTAEADVAALNRRIQLIEEDLERSEERLKVATAKLEEASHSADESERMRKMLEHRSITDEERMDGLESQLKEARLMAEDADRKYDEVARKLAMVEADLERAEERAETGESKIVELEEELRVVGNNLKSLEVSEEKAQQREEAYEQQIRIMTSKLKEAEARAEFAERSVQKLQKEVDRLEDELVHEKEKYESISDELDQTFAELTGY

SEQ ID NO: 1072 - protein, 131 aa, Tyrophagus putrescentiae (Storage mite)
MVQLNGSYKLEKSDNFDAFLKELGVNFVTRNLAKSASPTVEVIVDGDSYTIKTSSTLKNSEIKFKLGEEFEEDRADGKKVQTSVTKEGDNKLVQVQKGDKPVTIVREFSEEGLTVTATVNGVTSVRFYKRQ

SEQ ID NO: 1073 - protein, 659 aa, Tyrophagus putrescentiae (Storage mite)
MANKKTPAIGIDLGTTYSCVGVFQHGKVEIIANDQGNRTTPSYVAFTDTERLIGDAAKNQVAMNPTNTVFDAKRLIGRRFDDASVQADMKHWSFNVVNDDGKPKIEVEFKGEKKKFFPEEISSMVLTKMKETAEAYLGTTVTSAVITVPAYFNDSQRQATKDAGVIAGLNVLRIINEPTAAAIAYGLDKKTQGEKNVLIFDLGGGTFDVSILTIEDGIFEVKSTAGDTHLGGEDFDNRLVNHFVQEFKRKHKKDPSDNKRALRRLRTACERAKRTLSSSTQASIEIDSLYEGIDFYSSITRARFEELCADLFRSTLDPVEKSLRDAKLDKNQIHEIVLVGGSTRIPKIQKLLQDFFNGKELNKSINPDEAVAYGAAVQAAILNGDESSEVQQILLLDVAPLSLGIETAGGVMTALIKRNSTIPTKQTQTFSTYSDNQPGVLIQVYEGERAMTKDNNLLGKFELSGIPPAPRGVPQIEVTFDIDANGILNVSAVDKSTGKQNKITITNDKGRLSKEDIERMVKEAESYRDEDEKQRDRITARNTLESYAFQIKSSIEEEAIKSKISEEDRKKILDKVEETMKWLDSNALAEKDEFEHHRKELEAVCNPIMTKLYQQAGAAPGGGMPGGFPGGFPGATGAGDAPADDSKAKGSGPTIEEVD

SEQ ID NO: 1074 - protein, 153 aa, Tyrophagus putrescentiae (Storage mite)
MSVEELSKEQVQMLRKAFDMFDRDKKGYIHTNMVSTILRTLGQTFEENDLQQLIIEIDADGSGELEFDEFLTLTARFLVEEDTEAMQEELREAFRMYDKEGNGYIPTSALREILRALDDKLTEDELDEMIAEIDTDGSGTVDFDEFMEMMTGD

SEQ ID NO: 1075 - protein, 486 aa, Tyrophagus putrescentiae (Storage mite)
MSQVPIKFTQIFINNEWHNSVSGKTFPVINPATEEKIADVQEGDKADIDKAVTAAREAFKLGSTWRSMDASARGRLINKLADLIEIERQYLSELESLDNGKPLAEAEFDLDCTVATFRYYAGWADKIHGKTIPADGPVVSFTKIEPVGVCGQIIPWNYPALMLAWKWAPALAAGNTVILKPAEQTPLSALYIAKLAAEAGFPPGVINVVPGYGPTAGAALVAHPRVDKIAFTGSTEIGKLISKTASETLKRVTLELGGKSPLVVTESVDIPEAAQIAHDACFANMGQCCCAGTRTYVHESIYEEFVKHSAAIANKRVLGSPFDANVTQGPQIDAAQTAKILDLIESGKKQGARVVTGGQRSTRKGYFIEPTVFADVTDSMRIAQEEIFGPVQQILKYKSLDEVIDRCNSSAYGLAAGILTKDINQALKFSGAVQAGSVWVNCYDHTVVQTPFGGFKQSGHGRELGEEGLHGYCEVKTVTIKLAGGQ

SEQ ID NO: 1076 - protein, 131 aa, Tyrophagus putrescentiae (Storage mite)
MSWQSYVDNQICQHVDCRLAVIAGLQDGAVWAKFEKDLPKQITQQELKTIADAIRSNPNSFLEGGIHLGGEKYICIQADNSLVRGRKGSSALCIVATNTCLLAAATVDGFPPGQLNNVVEKLGDYLKANNY

SEQ ID NO: 1077 - protein, 301 aa, Vespa crabro (European hornet)
FNPCPYSDDTVKMIVLTRENKKYDFYTLDTIKNHNEFKDTITLKPHVFITHGFTSSATAENFVVMAKALLDKGNYLVILTDWRMAACTNEIAGLKLAYYPYAASNTRLVGNYIATVTKMLVQKYNVPMANIRLIGHSLGAHISGFAGKKVQELGLGKYPEIIGLDPAGPSFKSNDCSQRICETDANYVQIIHTSNRLGTERTLGTVDFYMNNGYNQPGCGLPIIGETCSHTRAVKYFTECIKHECCLIGVPKSKNPQPVSKCTRNECVCVGLNAKTYPKTGSFYVPVESKAPYCNNKGKII

SEQ ID NO: 1078 - protein, 202 aa, Vespa crabro (European hornet)
NNYCKIKCRSGIHTLCKYGTSTKPNCGKNVVKASGLTKQENLEILKQHNEFRQKVARGLETRGNPGPQPPAKSMNTLVWNDELAQIAQVWANQCNYGHDNCRNSAKYSVGQNIAEGSTTADNFGSVSNMVKMWEDEVKDYQYGSPKNKLNKVGHYTQMVWAKTKEIGCGSIKYIENGWHRHYLVCNYGPAGNVGNEPIYERK

SEQ ID NO: 1079 - protein, 202 aa, Vespa crabro (European hornet)
NNYCKIKCRSGIHTLCKYGTSTKPNCGKNVVKASGLTKQENLEILKQHNEFRQKVARGLETRGNPGPQPPAKSMNTLVWNDELAQIAQVWANQCNYGHDNCRNSAKYSVGQNIAEGSTSADNFVNVSNMVKMWEDEVKDYQYGSPKNKLNKVGHYTQMVWAKTKEIGCGSEDYIEDGWHRHYLVCNYGPAGNVGNEPIYERK

SEQ ID NO: 1080 - protein, 202 aa, Vespa mandarinia (Giant asian hornet)
NNYCKIKCRSGIHTLCKFGISTKPNCGKNVVKASGLTKAEKLEILKQHNEFRQKVARGLETRGKPGPQPPAKSMNTLVWNDELAQIAQVWAGQCDYGHDVCRNTAKYSVGQNIAENGSTAASFASVSNMVQMWADEVKNYQYGSTKNKLIEVGHYTQMVWAKTKEIGCGSIKYIENGWHRHYLVCNYGPAGNIGNEPIYERK

SEQ ID NO: 1081 - protein, 204 aa, Vespula flavopilosa (Yellow jacket)
NNYCKIKCLKGGVHTACKYGSLKPNCGNKVVVSYGLTKQEKQDILKEHNDFRQKIARGLETRGNPGPQPPAKNMKNLVWNDELAYVAQVWANQCQYGHDTCRDIAKYQVGQNVALTGSTAAKYDDPVKLVKMWEDEVKDYNPKKKFSGNNFLKTGHYTQMVWANTKEVGCGSIKFIQEKWHKHYLVCNYGPSGNFQNEELYQTK

SEQ ID NO: 1082 - protein, 204 aa, Vespula germanica (Yellow jacket)
NNYCKIKCLKGGVHTACKYESLKPNCANKKVVAYGLTKQEKQDILKEHNDFRQKIARGLETRGNPGPQPPAKNMKNLVWSDELAYIAQVWANQCQYGHDTCRDVAKYPVGQNVALTGSTAAKYDNPVKLVKMWEDEVKDYNPKKKFSENNFLKIGHYTQMVWANTKEVGCGSIKYIQDKWHKHYLVCNYGPSGNFGNEELYQTK

SEQ ID NO: 1083 - protein, 300 aa, Vespula maculifrons (Yellow jacket)
GPKCPFNSDTVSIIIETRENRNRDLYTLQTLQNHPEFKKKTITRPVVFITHGFTSSASEKNFINLAKALVDKDNYMVISIDWQTAACTNEYPGLKYAYYPTAASNTRLVGQYIATITQKLVKDYKISMANIRLIGHSLGAHVSGFAGKRVQELKLGKYSEIIGLDPARPSFDSNHCSERLCETDAEYVQIIHTSNYLGTEKILGTVDFYMNNGKNNPGCGRFFSEVCSHTRAVIYMAECIKHECCLIGIPRSKSSQPISRCTKQECVCVGLNAKKYPSRGSFYVPVESTAPFCNNKGKII

SEQ ID NO: 1084 - protein, 31 aa, Vespula maculifrons (Yellow jacket)
DRCIWPKEGFSIYWNIPTHFCHNFGVYFKEL

SEQ ID NO: 1085 - protein, 204 aa, Vespula maculifrons (Yellow jacket)
NNYCKIKCLKGGVHTACKYGSLKPNCGNKKVVSYGLTKQEKQDILKEHNDFRQKIARGLETRGNPGPQPPAKNMKNLVWSDELAYIAQVWANQCQYGHDTCRDVAKYQVGQNVALTGSTAAVYNDPVKLVKMWEDEVKDYNPKKKFSENNFLKIGHYTQMVWANTKEVGCGSIKYIQENWHKHYLVCNYGPSGNFQNEELYQTK

SEQ ID NO: 1086 - protein, 204 aa, Vespula pensylvanica (Yellow jacket)
NNYCKIKCLKGGVHTACKYGSLKPNCGNKIVVSYGLTKEEKQDILKEHNDFRQKIARGLETRGNPGPQPPAKNMKNLVWNDELAYVAQVWANQCQYGHDTCRDVAKYPVGQNVALTGSTADKYDNPVKLVKMWEDEVKDYNPKKKFSENNFNKIGHYTQMVWANTKEIGCGSIKYIQNEWHKHYLVCNYGPSGNFGNEELYQTK

SEQ ID NO: 1087 - protein, 298 aa, Vespula squamosa (Yellow jacket)
  misc_feature (72)..(75): Xaa can be any naturally occurring amino acid
GSKCPFSDDTVAMVIVTRENRNRDFYTLQTLRNHDEFKKKAITRPVVFITHGFTSSATVESFVDLQTAILEXXXXKVTVSDWRVAACNRTTGLLYYVTAVSNTRLVGRYIATVTKKLVTDYNVSMADIRLIGHSLGAHVSGFAGKEVQKLKLEKYSEIIGLDPAGPSFESNDCAERLCKTDAHYVQIIHTSKKFGIEKSIGHVDFYVNQGNNQPGCGIIPLKDVCSHSRAITYMTECIKRECCLIGIPQSKSSKSISSCTRQECVCVGLKAKSYPNTGSFYVPVESTAPFCNNKGKII

SEQ ID NO: 1088 - protein, 205 aa, Vespula squamosa (Yellow jacket)
VDYCKIKCLKGGVHTACKYGTSTKPNCGNMVVKSYGVTQAEKQEILKIHNDFRNKVARGLETRGNPGPQPPAKNMNNLVWNNELANIAQIWASQCKYGHDTCKDTTKYNVGQNIAVSSSTAAVYENVGNLVKAWENEVKDFNPTISWEQNEFKKIGHYTQMVWAKTKEIGCGSIKYVDNNWYTHYLVCNYGPAGNFGNQEVYERK

SEQ ID NO: 1089 - protein, 206 aa, Vespula vidua (Wasp)
KVNYCKIKCLKGGVHTACKYGTSTKPNCGKMVVKAYGLTEAEKQEILKVHNDFRQKVAKGLETRGNPGPQPPAKNMNNLVWNDELANIAQVWASQCNYGHDTCKDTEKYPVGQNIAKRSTTAALFDSPGKLVKMWENEVKDFNPNIEWSKNNLKKTGHYTQMVWAKTKEIGCGSVKYVKDEWYTHYLVCNYGPSGNFRNEKLYEKK

SEQ ID NO: 1090 - protein, 336 aa, Vespula vulgaris (Yellow jacket)
MEENMNLKYLLLFVYFVQVLNCCYGHGDPLSYELDRGPKCPFNSDTVSIIIETRENRNRDLYTLQTLQNHPEFKKKTITRPVVFITHGFTSSASETNFINLAKALVDKDNYMVISIDWQTAACTNEAAGLKYLYYPTAARNTRLVGQYIATITQKLVKHYKISMANIRLIGHSLGAHASGFAGKKVQELKLGKYSEIIGLDPARPSFDSNHCSERLCETDAEYVQIIHTSNYLGTEKTLGTVDFYMNNGKNQPGCGRFFSEVCSHSRAVIYMAECIKHECCLIGIPKSKSSQPISSCTKQECVCVGLNAKKYPSRGSFYVPVESTAPFCNNKGKII

SEQ ID NO: 1091 - protein, 331 aa, Vespula vulgaris (Yellow jacket)
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 1092 - protein, 340 aa, Vespula vulgaris (Yellow jacket)
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 1093 - protein, 776 aa, Vespula vulgaris (Yellow jacket)
MVPLRSFVLLNSLFLVLLAARTVVTRVIDKDNSDRIVKTQNDQNLSKVPFNLEETYTADFLAYVFNGTWTSDTTIVYTDRRTGDILQFDVIKQRSTLIVDSSVMDAYIVSNYVLSPKGRYLLIGYDLKKGYRYSTFMRYVIYDIEHRAYHKIGNDMHIALAKWAPLTDDLIYILDNDIYYMRFSNNGFNDVQRVTYDGISGIVYNGVPDWVYEEEVLQDSSAIWFSPDGNHLAYASFDDRNVQEILYLHYGEPGNLDDQYPTEVKIKYPKVGTLNPVVSLTLVDLHDPTLNKIDLKAPHYAVGTDNLLYNVQWKDFDHVVVTWSNRVQNKTEIVWYNMYGEIVKTLHVVEHKGWLDIKHLFFYKGSVYIRKLQPSGTKAGRFHHVTRYDETFKQSPTQMDLTPDAIEVQNICTIDQSNGRIYYLASGLGKPSQKNLYSVPADGSEKPTCISCNVLTPEGNVCTYADAIFSPLGQYYVLVCHGPDPAFVSIFNNAHQKVYSWENNLSLRKKLAKRHLPLVKDLDVRANGYESKVRLFLPHNFDESKSYPMLVNVYAGPNTLKIIDAASYGHQVYMTTNRSVIYAYIDGRGSSNKGSKMLFSIYRKLGTVEVEDQITVTRQLQEMFPWIDSKRTGVWGWSYGGFSTAMILAKDTSFVFKCGIAIAPVSSWIYYDSIYTERFMGFPTPEDNLSGYNETDVSRRVEDIRGKKFMLIHGSGDDNVHYQQSLALAKALEKADVMFEQITYTDEAHALFGVLPHLYHTMDRFWSDCFSLSHAH

SEQ ID NO: 1094 - protein, 227 aa, Vespula vulgaris (Yellow jacket)
MEISGLVYLIIIVTIIDLPYGKANNYCKIKCLKGGVHTACKYGSLKPNCGNKVVVSYGLTKQEKQDILKEHNDFRQKIARGLETRGNPGPQPPAKNMKNLVWNDELAYVAQVWANQCQYGHDTCRDVAKYQVGQNVALTGSTAAKYDDPVKLVKMWEDEVKDYNPKKKFSGNDFLKTGHYTQMVWANTKEVGCGSIKYIQEKWHKHYLVCNYGPSGNFMNEELYQTK

SEQ ID NO: 1095 - protein, 1756 aa, Vespula vulgaris (Yellow jacket)
MRSRFILLLLGVAVSNLDNNIEHGWKVGEEYQYLVRSRTLTGLQTLSDQYAGILMKATLRIQCNSPDTLRAQLLKPQYAQIHKKLPDGWDSRISDQMLEHKHLPLSNEPFVIKLKHGVIRDLIVSKNVPTWEVNIIKSIISQFQADTQGENLKGNKNTQIPEDDNPFATFRVMEDCVSGKCEVLYDVVPLTEDVLQHRPHILPKPELRGNGEHIYITKTRNYDKCEQRMDYYFGISGNANWESDIRNNDKIMKKSSTSNMVISGNLKNFVIQTAVTTTEIIMKPRLVDDQESIVISKMNVTLVSVNKVSSPIPAPNNPESTGNLVYTYNDPFSKTVQRRLGRPSVSPNSMSNELDSSADSDEDLRLMREKYGKSDKMNVVSDEDKAFRQMKPTLHEAPKNPMLPLFIGNNGKAVVMSDKINSGKMVMTLVQEIASEMEDPNVMPDRETLEKFTIVSRLISSMSLEQINKAEGSLHSVWNEIGSDETNRMKKENARAVFRDAIANAGTGPALMTIKRWIEKKEIEGCEAADVLASIPKTARTPTAEYVDAFFSLASNPEVQKQTCLNSSAVLSFAELVHRAQVSNSSIYNHYPVNVFGRLSSRRNDAVLRKYIPFFAEELKKAIKDGDSPRIQVYILALGLTGHPKILNVLEPYLEGKERVSTYQRFLMVMSLRKLCEVKPSLARSVLYKIYLNTWDVHQIRCAAVNLIMRTNPPLDMLTRMAQFTNTDFSGQVNSAVKSAIESAANLNYPEWEELTRNARKVLHLMNTESDKYYYSESHFTEMEENDQLSYRMMLNYIGSVDNVIPLSTHFALQPSYNGFLSPVYELDMSISSVKSLLEMYWHKSEKGDTEESFAEKTAKMLHIESDNVEQVEGNVFFKTPYLNRYFSFDNHTIERILHDMVSPRHSHHVNMNKLLSYDITLSFPTETGLPFVYSLHVPTIKKFSVISKPDMKSKFDVRLLTSTKHQGRVGFITPFDHQAFLSGIDNNMQVFLPCKLDFHLNNEKSRLDAALQPLKHNSKTRLGHFSVIPYTSQYEIMSLRPLLLEKNTHRIQEKKTTHIRIPQNPNSIFSVEVEADNLAEKIQQWLRSENKWEDMLSPSSLALGTYEKIDLFVKPDLQENEAVKFTATLDTKEIRSNNLDTNDESWKSGNKVLKTMHQALDSPARRKEFLQEVVKGINSGKAYVIDAGLEVPGLWKSNHACTLCLASSNDENKFRSIFYWYTNIPSQDITYQMCVNGQTRSSPTTPFDYKKILDSNPTNEFSINIQSGRTCTDNSLVTIKGQIKQSEDYKTYVQESRIVKRCDENVRNSVKDCQKAAEMAKNLNEIDMTITKHNSAEESDTELEKIFHGTKKMLTGLNVRVVSEIQEHSDVNDNDIRVQIKLSPNMTSAEGMASKSGQILTFSDIHIDMGIDNDDEMNEIEKGILHGATCTLRNNEAETFDGKVYPLKLGKCAHVLFTTYPRNAPNEPNKRMSIPENMKVTVIAEETENNKKELQILLGNDEILFKSSGTEVSAWVNGQKVKCSQKESYQHIKNDETLFEIFELPGPAIKLISDKYDIKLAYDTDHVQIEVPHTYQQSVRGLCGDFDGRSENDFVTPKNCMLQKPEEFAATYILKERCEGPALNNAKKAERSKCIRKVLRFSDVISDGEAGRPYVNWKQWGYHKKENKKQCNTYRTQIITKDDNICFTIRPVPTCSSGCKSVVTKLKEYQLYCLPKNDSSLGMKKRIEQGANPDLSQRTPTDNAMISVPLECVAT

SEQ ID NO: 1096 - protein, 172 aa, Bos domesticus Bos taurus (domestic cattle)
MKAVFLTLLFGLVCTAQETPAEIDPSKIPGEWRIIYAAADNKDKIVEGGPLRNYYRRIECINDCESLSITFYLKDQGTCLLLTEVAKRQEGYVYVLEFYGTNTLEVIHVSENMLVTYVENYDGERITKMTEGLAKGTSFTPEELEKYQQLNSERGVPNENIENLIKTDNCPP

SEQ ID NO: 1097 - protein, 172 aa, Bos domesticus Bos taurus (domestic cattle); identical to SEQ ID NO: 1096

SEQ ID NO: 1098 - protein, 101 aa, Bos domesticus Bos taurus (domestic cattle)
MSSSQLEQAITDLINLFHKYSGSDDTIEKEDLLRLMKDNFPNFLGACEKRGRDYLSNIFEKQDKNKDRKIDFSEFLSLLADIATDYHNHSHGAQLCSGGNQ

SEQ ID NO: 1099 - protein, 142 aa, Bos domesticus Bos taurus (domestic cattle)
MMSFVSLLLVGILFHATQAEQLTKCEVFRELKDLKGYGGVSLPEWVCTTFHTSGYDTQAIVQNNDSTEYGLFQINNKIWCKDDQNPHSSNICNISCDKFLDDDLTDDIMCVKKILDKVGINYWLAHKALCSEKLDQWLCEKL

SEQ ID NO: 1100 - protein, 178 aa, Bos domesticus Bos taurus (domestic cattle)
MKCLLLALALTCGAQALIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCHI

SEQ ID NO: 1101 - protein, 607 aa, Bos domesticus Bos taurus (domestic cattle)
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSHKDDSPDLPKLKPDPNTLCDEFKADEKKFWGKYLYEIARRHPYFYAPELLYYANKYNGVFQECCQAEDKGACLLPKIETMREKVLASSARQRLRCASIQKFGERALKAWSVARLSQKFPKAEFVEVTKLVTDLTKVHKECCHGDLLECADDRADLAKYICDNQDTISSKLKECCDKPLLEKSHCIAEVEKDAIPENLPPLTADFAEDKDVCKNYQEAKDAFLGSFLYEYSRRHPEYAVSVLLRLAKEYEATLEECCAKDDPHACYSTVFDKLKHLVDEPQNLIKQNCDQFEKLGEYGFQNALIVRYTRKVPQVSTPTLVEVSRSLGKVGTRCCTKPESERMPCTEDYLSLILNRLCVLHEKTPVSEKVTKCCTESLVNRRPCFSALTPDETYVPKAFDEKLFTFHADICTLPDTEKQIKKQTALVELLKHKPKATEEQLKTVMENFVAFVDKCCAADDKEACFAVEGPKLVVSTQTALA

SEQ ID NO: 1102 - protein, 214 aa, Bos domesticus Bos taurus (domestic cattle)
MKLLILTCLVAVALARPKHPIKHQGLPQEVLNENLLRFFVAPFPEVFGKEKVNELSKDIGSESTEDQAMEDIKQMEAESISSSEEIVPNSVEQKHIQKEDVPSERYLGYLEQLLRLKKYKVPQLEIVPNSAEERLHSMKEGIHAQQKEPMIGVNQELAYFYPELFRQFYQLDAYPSGAWYYVPLGTQYTDAPSFSDIPNPIGSENSEKTTMPLW

SEQ ID NO: 1103 - protein, 222 aa, Bos domesticus Bos taurus (domestic cattle)
MKFFIFTCLLAVALAKNTMEHVSSSEESIISQETYKQEKNMAINPSKENLCSTFCKEVVRNANEEEYSIGSSSEESAEVATEEVKITVDDKHYQKALNEINQFYQKFPQYLQYLYQGPIVLNPWDQVKRNAVPITPTLNREQLSTSEENSKKTVDMESTEVFTKKTKLTEEEKNRLNFLKKISQRYQKFALPQYLKTVYQHQKAMKPWIQPKTKVIPYVRYL

SEQ ID NO: 1104 - protein, 224 aa, Bos domesticus Bos taurus (domestic cattle)
MKVLILACLVALALARELEELNVPGEIVESLSSSEESITRINKKIEKFQSEEQQQTEDELQDKIHPFAQTQSLVYPFPGPIPNSLPQNIPPLTQTPVVVPPFLQPEVMGVSKVKEAMAPKHKEMPFPKYPVEPFTESQSLTLTDVENLHLPLPLLQSWMHQPHQPLPPTVMFPPQSVLSLSQSKVLPVPQKAVPYPQRDMPIQAFLLYQEPVLGPVRGPFPIIV

SEQ ID NO: 1105 - protein, 190 aa, Bos domesticus Bos taurus (domestic cattle)
MMKSFFLVVTILALTLPFLGAQEQNQEQPIRCEKDERFFSDKIAKYIPIQYVLSRYPSYGLNYYQQKPVALINNQFLPYPYYAKPAAVRSPAQILQWQVLSNTVPAKSCQAQPTTMARHPHPHLSFMAIPPKKNQDKTEIPTINTIASGEPTSTPTTEAVESTVATLEDSPEVIESPPEINTVQVTSTAV

SEQ ID NO: 1106 - protein, 174 aa, Canis familiaris (dog)
MKTLLLTIGFSLIAILQAQDTPALGKDTVAVSGKWYLKAMTADQEVPEKPDSVTPMILKAQKGGNLEAKITMLTNGQCQNITVVLHKTSEPGKYTAYEGQRVVFIQPSPVRDHYILYCEGELHGRQIRMAKLLGRDPEQSQEALEDFREFSRAKGLNQEILELAQSETCSPGGQ

SEQ ID NO: 1107 - protein, 180 aa, Canis familiaris (dog)
MQLLLLTVGLALICGLQAQEGNHEEPQGGLEELSGRWHSVALASNKSDLIKPWGHFRVFIHSMSAKDGNLHGDILIPQDGQCEKVSLTAFKTATSNKFDLEYWGHNDLYLAEVDPKSYLILYMINQYNDDTSLVAHLMVRDLSRQQDFLPAFESVCEDIGLHKDQIVVLSDDDRCQGSRD

SEQ ID NO: 1108 - protein, 608 aa, Canis familiaris (dog)
MKWVTFISLFFLFSSAYSRGLVRREAYKSEIAHRYNDLGEEHFRGLVLVAFSQYLQQCPFEDHVKLAKEVTEFAKACAAEESGANCDKSLHTLFGDKLCTVASLRDKYGDMADCCEKQEPDRNECFLAHKDDNPGFPPLVAPEPDALCAAFQDNEQLFLGKYLYEIARRHPYFYAPELLYYAQQYKGVFAECCQAADKAACLGPKIEALREKVLLSSAKERFKCASLQKFGDRAFKAWSVARLSQRFPKADFAEISKVVTDLTKVHKECCHGDLLECADDRADLAKYMCENQDSISTKLKECCDKPVLEKSQCLAEVERDELPGDLPSLAADFVEDKEVCKNYQEAKDVFLGTFLYEYARRHPEYSVSLLLRLAKEYEATLEKCCATDDPPTCYAKVLDEFKPLVDEPQNLVKTNCELFEKLGEYGFQNALLVRYTKKAPQVSTPTLVEVSRKLGKVGTKCCKKPESERMSCAEDFLSVVLNRLCVLHEKTPVSERVTKCCSESLVNRRPCFSGLEVDETYVPKEFNAETFTFHADLCTLPEAEKQVKKQTALVELLKHKPKATDEQLKTVMGDFGAFVEKCCAAENKEGCFSEEGPKLVAAAQAALV

SEQ ID NO: 1109 - protein, 174 aa, Canis familiaris (dog)
MKILLLCLALVLASDAQLPLPNVLTQVSGPWKTLYISSNNLDKIGDNGPFRIYMRGINVDIPRLKMSFNFYVKVDGECVENSVGASIGRDNLIKGEYNGGNYFRIIDMTPNALIGYDVNVDSKGKITKVALLMGRGAHVNEEDIAKFKKLSREKGIPEENIIYLGDTDNCPNHE

SEQ ID NO: 1110 - protein, 260 aa, Canis familiaris (dog)
MWFLALCLAMSLGWTGAEPHFQPRIIGGRECLKNSQPWQVAVYHNGEFACGGVLVNPEWVLTAAHCANSNCEVWLGRHNLSESEDEGQLVQVRKSFIHPLYKTKVPRAVIRPGEDRSHDLMLLHLEEPAKITKAVRVMDLPKKEPPLGSTCYVSGWGSTDPETIFHPGSLQCVDLKLLSNNQCAKVYTQKVTKFMLCAGVLEGKKDTCKGDSGGPLICDGELVGITSWGATPCGKPQMPSLYTRVMPHLMWIKDTMKANT

SEQ ID NO: 1111 - protein, 190 aa, Canis familiaris (dog)
MKLLLLCLGLILVHAHEEENDVVKGNFDISKISGDWYSILLASDIKEKIEENGSMRVFVKDIEVLSNSSLIFTMHTKVNGKCTKISLICNKTEKDGEYDVVHDGYNLFRIIETAYEDYIIFHLNNVNQEQEFQLMELYGRKPDVSPKVKEKFVRYCQGMEIPKENILDLTQVDRCLQARQSEAAQVSSAE

SEQ ID NO: 1112 - protein, 149 aa, Canis familiaris (dog)
MRLLVAAFLLLALGDLGPGGAVHFKDCGSAVGVIKELNVNPCPAQPCKLHKGQSYSVNVTFTSNIPSQSSKAVVHGIVLGVAVPFPIPEADGCKSGINCPIQKDKTYSYLNKLPVKNEYPSIKLVVQWMLLGDNNQHLFCWEIPVQIEG

SEQ ID NO: 1113 - protein, 15 aa, Cavia porcellus (guinea pig)
SEINGDWNTIALSAD

SEQ ID NO: 1114 - protein, 170 aa, Cavia porcellus (guinea pig)
MMQILLLALAVSLACADSIDYSKVPGNWRTIAIAADHVEKIEVNGELRAYFRQVDCTEGCDKISITFYTNTDGVCTEHTVVGARNGENDVYTVDYAGENTFQILCNSDDAFVIGSVNTDQNGQTTKEVAIAAKRNFLTPEQEQKFQKAVQNAGIPLENIRYVIETDTCPD

SEQ ID NO: 1115 - protein, 170 aa, Cavia porcellus (guinea pig)
MQILLLALTIGLAYAHQTLDPSEINGQWHTISIAADNVEKIGEGGPLRGYFHNLHCYDGCKNIGLTFYVKLDGNCQRFDVLGAKQEDSDVYVAQYSGTNHFEVIGKKEDAIAFYNHNTDETGKETKMIVVVARRDSLTEEEQQKLQEVAGEKGIPKDNIRYFRERDTCAQ

SEQ ID NO: 1116 - protein, 608 aa, Cavia porcellus (guinea pig)
MKWVTFISLLFLFSSVYSRGVFRREAHKSEIAHRFNDLGEGHFKGLVLITLSQHLQKSPFEEHVKLVNEVTDFAKACVADESAQNCGKAIATLFGDKVCAIPSLRETYGELADCCAKEDPDRVECFLQHKDDNPNLPPFERPEPEALCTAFKENNDRFIGHYLYEVSRRHPYFYAPELLYYAEKYKNALTECCEAADKAACLTPKLDAIKEKALVSSAQQRLKCASLQKFGERAFKAWSVARLSQKFPKAEFAEISTIVTSLTKVTKECCHGDLLECADDRQELAKYMCEHQDSISSKLKECCVKPTLQKAHCILEIQRDELPTELPDLAVDFVEDKEVCKNFAEAKDVFLGTFLYEYSRRHPEYSIGMLLRIAKGYEAKLEKCCAEADPHACYAKVFDELQPLIDEPKKLVQQNCELFDKLGEYGFQNALAVRYTQKAPQVSTPTLVEYARKLGSVGTKCCSLPETERLSCTENYLALILNRLCILHEKTPVSERVTKCCTESLVNRRPCFSALHVDETYVPKPFHADSFTFHADICTLPEKEKQVKKQMALVELVKHKPKASEEQMKTVMGDFAAFLKKCCDADNKEACFTEDGPKLVAKCQATLA

SEQ ID NO: 1117 - protein, 181 aa, Cavia porcellus (guinea pig)
MKLQLLCLGLILLCTQGEGDEVVRGNFDAEKISGNWYTVKEASDKRETIEEGGSMRVFVESIEPVKDSALSFKFWAHENGECKQISLICNRVAEGVYAVEYDGYNVFRVAETDYKNYAIFQLRNFKAEGSFQLLELYGREPDVSGEIKTRFEDFCHKNGIGEGNIIDMTTVDRCLQARGEK

SEQ ID NO: 1118 - protein, 109 aa, Clupea harengus (Atlantic herring)
MALASLLKGADIDAALKACEAKDSFKHKDFFAKIGLATKSAADLKKAFEIIDQDKSGFIEEEELKLFLQNFKAGARALTDAETKAFLKAGDADGDGMIGVDEFAVMIKP

SEQ ID NO: 1119 - protein, 110 aa, Clupea harengus (Atlantic herring)
MAFAGLLSDADIAAALGACTAADTFDHKSFFKKVGLSGKSADDVKKPFYIIDQDKSGFIEEEELKLFLQNFKAGARALSDKETKAFLAAGDADGDGMIGVDEFAVMVKAR

SEQ ID NO: 1120 - protein, 109 aa, Clupea harengus (Atlantic herring)
MAFAAFLKEADITAALGACKGADSFDHKAFFAKVGLKGKSGDELKKAFEIIDQDKSGFIEEEELKLFLQNFCKGARALTDGETKKFLKAGDSDNDGKIGIDEFAALINH

SEQ ID NO: 1121 - protein, 109 aa, Cyprinus carpio (Common carp)
MAFAGILNDADITAALQGCQAADSFDYKSFFAKVGLSAKTPDDIKKAFAVIDQDKSGFIEEDELKLFLQNFSAGARALTDAETKAFLKAGDSDGDGKIGVDEFAALVKA

SEQ ID NO: 1122 - protein, 109 aa, Cyprinus carpio (Common carp)
MAFAGVLNDADITAALEACKAADSFNHKTFFAKVGLTSKSADDVKKAFAIIDQDKSGFIEEDELKLFLQNFKAGARALTDGETKTFLKAGDSDGDGKIGVDEFTALVKA

SEQ ID NO: 1123 - protein, 187 aa, Equus caballus (domestic horse)
MKLLLLCLGLILVCAQQEENSDVAIRNFDISKISGEWYSIFLASDVKEKIEENGSMRVFVDVIRALDNSSLYAEYQTKVNGECTEFPMVFDKTEEDGVYSLNYDGYNVFRISEFENDEHIILYLVNFDKDRPFQLFEFYAREPDVSPEIKEEFVKIVQKRGIVKENIIDLTKIDRCFQLRGNGVAQA

SEQ ID NO: 1124 - protein, 29 aa, Equus caballus (domestic horse)
  misc_feature (3)..(3): Xaa can be any naturally occurring amino acid
  misc_feature (28)..(28): Xaa can be any naturally occurring amino acid
SQXPQSETDYSQLSGEWNTIYGAASNIXK

SEQ ID NO: 1125 - protein, 19 aa, Equus caballus (domestic horse)
  misc_feature (1)..(1): Xaa can be any naturally occurring amino acid
XQDPQSETDYSQLSGEWNT

SEQ ID NO: 1126 - protein, 607 aa, Equus caballus (domestic horse)
MKWVTFVSLLFLFSSAYSRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKLACLIPKLDALKERILLSSAKERLKCSSFQNFGERAVKAWSVARLSQKFPKADFAEVSKIVTDLTKVHKECCHGDLLECADDRADLAKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYRTVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYVPKEFKAETFTFHADICTLPEDEKQIKKQSALAELVKHKPKATKEQLKTVLGNFSAFVAKCCGREDKEACFAEEGPKLVASSQLALA

SEQ ID NO: 1127 - protein, 228 aa, Equus caballus (domestic horse)
MLKVSCLFVLLCGLLVPSSAQQIPPEVSSQITDALTQGLLDGNFLSLLNAINLEGLLNTILDQVTGLLNILVGPLLGPSDAEIKLQDTRLLQLSLEFSPDSKGIDIWIPLELSVYLKLLILEPLTLYVRTDIRVQLRLESDEDGKYRLAFGHCSLLPRAIELQSGNPLSLPVNAVLGTIENALGNFITEDLGAGLCPTLNSLVSNLDLQLVNNLINLILDRANVDLSV

SEQ ID NO: 1128 - protein, 92 aa, Felis domesticus (cat)
MKGACVLVLLWAALLLISGGNCEICPAVKRDVDLFLTGTPDEYVEQVAQYKALPVVLENARILKNCVDAKMTEEDKENALSVLDKIYTSPLC

SEQ ID NO: 1129 - protein, 109 aa, Felis domesticus (cat)
MRGALLVLALLVTQALGVKMAETCPIFYDVFFAVANGNELLLDLSLTKVNATEPERTAMKKIQDCYVENGLISRVLDGLVMTTISSSKDCMGEAVQNTVEDLKLNTLGR

SEQ ID NO: 1130 - protein, 608 aa, Felis domesticus (cat)
MKWVTFISLLLLFSSAYSRGVTRREAHQSEIAHRFNDLGEEHFRGLVLVAFSQYLQQCPFEDHVKLVNEVTEFAKGCVADQSAANCEKSLHELLGDKLCTVASLRDKYGEMADCCEKKEPERNECFLQHKDDNPGFGQLVTPEADAMCTAFHENEQRFLGKYLYEIARRHPYFYAPELLYYAEEYKGVFTECCEAADKAACLTPKVDALREKVLASSAKERLKCASLQKFGERAFKAWSVARLSQKFPKAEFAEISKLVTDLAKIHKECCHGDLLECADDRADLAKYICENQDSISTKLKECCGKPVLEKSHCISEVERDELPADLPPLAVDFVEDKEVCKNYQEAKDVFLGTFLYEYSRRHPEYSVSLLLRLAKEYEATLEKCCATDDPPACYAHVFDEFKPLVEEPHNLVKTNCELFEKLGEYGFQNALLVRYTKKVPQVSTPTLVEVSRSLGKVGSKCCTHPEAERLSCAEDYLSVVLNRLCVLHEKTPVSERVTKCCTESLVNRRPCFSALQVDETYVPKEFSAETFTFHADLCTLPEAEKQIKKQSALVELLKHKPKATEEQLKTVMGDFGSFVDKCCAAEDKEACFAEEGPKLVAAAQAALA

SEQ ID NO: 1131 - protein, 98 aa, Felis domesticus (cat)
MIPGGLSEAKPATPEIQEIANEVKPQLEEKTNETYQKFEAIEYKTQVVAGINYYIKVQVDDNRYIHIKVFKGLPVQDSSLTLTGYQTGKSEDDELTGF

SEQ ID NO: 1132 - protein, 186 aa, Felis domesticus (cat)
MKLLLLCLGLILVCAHEEENVVRSNIDISKISGEWYSILLASDVKEKIEENGSMRVFVEHIKALDNSSLSFVFHTKENGKCTEIFLVADKTKDGVYTVVYDGYNVFSIVETVYDEYILLHLLNFDKTRPFQLVEFYAREPDVSQKLKEKFVKYCQEHGIVNILDLTEVDRCLQARGSEVAQDSSVE

SEQ ID NO: 1133 - protein, 180 aa, Felis domesticus (cat)
MKALLLAVGLSLITVLQAQDPPASGEDTMAMSGKWYLKAMITDRETSWKKPELVTPMTLTVLEGGNLKAETTLLTNGQCKEVELILEKTSEPKKYTTYGGKRVVYIEPTEVKDHYIFYCEGEMQGEQARMAKLVGRDPESNEEALENFREFLRAKGFNQEIFSPKQSDTCPPGTDQEPEV

SEQ ID NO: 1134 - protein, 228 aa, Felis domesticus (cat)
MLKVSSLFILLCGLLASSSTQEVLSRVSSHITDALTQGLLGMNFLPTLQTIDFQGPLKDIFSLVLGHQLTNGEANFMVQMKDLRLFQVFIETSPDFKGIDLRMPLAFSIQIKFPALNPYIFHVRTDMKVQLYLEKDVDNRYQLTFGHCRIVPETVWIQSGNFITPMKNFIVENIERALGNVIIHNFGAKMCPFINSWLYNLNPQVTNQLISLLLQHGTYQATVEIPAK

SEQ ID NO: 1135 - protein, 113 aa, Gadus callarias (Baltic cod)
AFKGILSNADIKAAEAACFKEGSFDEDGFYAKVGLDAFSADELKKLFKIADEDKEGFIEEDELKLFLIAFAADLRALTDAETKAFLKAGDSDGDGKIGVDEFGALVDKWGAKG

SEQ ID NO: 1136 - protein, 109 aa, Gadus morhua (Atlantic cod)
MAFAGILADADCAAAVKACEAAESFSYKAFFAKCGLSGKSADDIKKAFFVIDQDKSGFIEEDELKLFLQVFKAGARALTDAETKAFLKAGDSDGDGAIGVDEWAVLVKA

SEQ ID NO: 1137 - protein, 109 aa, Gadus morhua (Atlantic cod)
MAFAGILADADCAAAVKACEAAESFSYKAFFAKCGLSGKSADDIKKAFFVIDQDKSGFIEEDELKLFLQVFKAGARALTDAETKAFLKAGDSDGDGAIGVEEWAVLVKA

SEQ ID NO: 1138 - protein, 109 aa, Gadus morhua (Atlantic cod)
MAFAGILNDADITAALAACKAEGSFDHKAFFTKVGLAAKSPADIKKVFEIIDQDKSDFVEEDELKLFLQNFSAGARALSDAETKVFLKAGDSDGDGKIGVDEFGAMIKA

SEQ ID NO: 1139 - protein, 109 aa, Gadus morhua (Atlantic cod)
MAFAGILNDADITAALAACKAEGSFDHKAFFTKVGLAAKSSADIKKVFEIIDQDKSDFVEEDELKLFLQNFSAGARALSDAETKVFLKAGDSDGDGKIGVDEFGAMIKA

SEQ ID NO: 1140 - protein, 11 aa, Gadus morhua (Atlantic cod)
SITKIKAREIL

SEQ ID NO: 1141 - protein, 15 aa, Gadus morhua (Atlantic cod)
PHAYPFLSPEQKKEL

SEQ ID NO: 1142 - protein, 210 aa, Gallus domesticus (chicken)
MAMAGVFVLFSFVLCGFLPDAAFGAEVDCSRFPNATDKEGKDVLVCNKDLRPICGTDGVTYTNDCLLCAYSIEFGTNISKEHDGECKETVPMNCSSYANTTSEDGKVMVLCNRAFNPVCGTDGVTYDNECLLCAHKVEQGASVDKRHDGGCRKELAAVSVDCSEYPKPDCTAEDRPLCGSDNKTYGNKCNFCNAVVESNGTLTLSHFGKC

SEQ ID NO: 1143 - protein, 386 aa, Gallus domesticus (chicken)
MGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 1144 - protein, 705 aa, Gallus domesticus (chicken)
MKLILCTVLSLGIAAVCFAAPPKSVIRWCTISSPEEKKCNNLRDLTQQERISLTCVQKATYLDCIKAIANNEADAISLDGGQAFEAGLAPYKLKPIAAEVYEHTEGSTTSYYAVAVVKKGTEFTVNDLQGKTSCHTGLGRSAGWNIPIGTLLHRGAIEWEGIESGSVEQAVAKFFSASCVPGATIEQKLCRQCKGDPKTKCARNAPYSGYSGAFHCLKDGKGDVAFVKHTTVNENAPDQKDEYELLCLDGSRQPVDNYKTCNWARVAAHAVVARDDNKVEDIWSFLSKAQSDFGVDTKSDFHLFGPPGKKDPVLKDLLFKDSAIMLKRVPSLMDSQLYLGFEYYSAIQSMRKDQLTPSPRENRIQWCAVGKDEKSKCDRWSVVSNGDVECTVVDETKDCIIKIMKGEADAVALDGGLVYTAGVCGLVPVMAERYDDESQCSKTDERPASYFAVAVARKDSNVNWNNLKGKKSCHTAVGRTAGWVIPMGLIHNRTGTCNFDEYFSEGCAPGSPPNSRLCQLCQGSGGIPPEKCVASSHEKYFGYTGALRCLVEKGDVAFIQHSTVEENTGGKNKADWAKNLQMDDFELLCTDGRRANVMDYRECNLAEVPTHAVVVRPEKANKIRDLLERQEKRFGVNGSEKSKFMMFESQNKDLLFKDLTKCLFKVREGTTYKEFLGDKFYTVISSLKTCNPSDILQMCSFLEGK

SEQ ID NO: 1145 - protein, 147 aa, Gallus domesticus (chicken)
MRSLLILVLCFLPLAALGKVFGRCELAAAMKRHGLDNYRGYSLGNWVCVAKFESNFNTQATNRNTDGSTDYGILQINSRWWCNDGRTPGSRNLCNIPCSALLSSDITASVNCAKKIVSDGNGMSAWVAWRNRCKGTDVQAWIRGCRL

SEQ ID NO: 1146 - protein, 615 aa, Gallus domesticus (chicken)
MKWVTLISFIFLFSSATSRNLQRFARDAEHKSEIAHRYNDLKEETFKAVAMITFAQYLQRCSYEGLSKLVKDVVDLAQKCVANEDAPECSKPLPSIILDEICQVEKLRDSYGAMADCCSKADPERNECFLSFKVSQPDFVQPYQRPASDVICQEYQDNRVSFLGHFIYSVARRHPFLYAPAILSFAVDFEHALQSCCKESDVGACLDTKEIVMREKAKGVSVKQQYFCGILKQFGDRVFQARQLIYLSQKYPKAPFSEVSKFVHDSIGVHKECCEGDMVECMDDMARMMSNLCSQQDVFSGKIKDCCEKPIVERSQCIMEAEFDEKPADLPSLVEKYIEDKEVCKSFEAGHDAFMAEFVYEYSRRHPEFSIQLIMRIAKGYESLLEKCCKTDNPAECYANAQEQLNQHIKETQDVVKTNCDLLHDHGEADFLKSILIRYTKKMPQVPTDLLLETGKKMTTIGTKCCQLGEDRRMACSEGYLSIVIHDTCRKQETTPINDNVSQCCSQLYANRRPCFTAMGVDTKYVPPPFNPDMFSFDEKLCSAPAEEREVGQMKLLINLIKRKPQMTEEQIKTIADGFTAMVDKCCKQSDINTCFGEEGANLIVQSRATLGIGA

SEQ ID NO: 1147 - protein, 1912 aa, Gallus domesticus (chicken)
MRGLISALVLTLVGSQHLNYQPDFGENKVYTYNYESILFSGIPEKGLARTGIRIRSEVEISGIGPKLCLIRIHSIEAAEYNGIWPTSSFSRSLKLTQALTGQLSIPIKFEYSNGHVGNLMAPDSVSDDGLNIYRGILNILELSLKKMQHSYSIQEAGIGGICNTTYAIQENKKANLVDVTKSKDLNSCEEKVQVVTGSAYTQPCQTCQQRNKNSRATATYNYKIKYTHNEAVITQAEVEEVHQFTPFHEITGGNAIVEARQKLALIEVQKQVAEVPPKEFQKRGSLQYQFGSELLQLPVHLFKIKDVERQIEERLQDLVETTYEQLPSDAPAKALKLMHLLRAANEENYESVWKQFSSRPAYRRYLLDLLPAAASHRSLRFLRHKMERQELTNWEIAQTVLVALHSSSPTQEVMEEATLIVKKHCPRSSSVLRKVCLLSYASLCHKRCSSPYSCSECLQVFHVFAGEALGKSNIEEVLLALKALGNVGHPASIKHIKKFLPGYAAGASELPLKVHETAVMALKSIGMRDPQMVQAITLEIFLNHKIHPRIRMLAAVVLLETKPGLPILMILVDAVLKEPSMQVASFIYSHLRALGRSTAPDLQMMASACRMAVRALSPKFDRSGYQFSKVFRFSMFKEFLMSGLAAKYFVLNNAGSLIPTMAVSQLRTHFLGRVADPIEVGIAAEGLQEMFVRGYSPDKDWETNYDFREILKKLSDWKALPRDKPFASGYLKMFGQELLFGRLDKDTLQNVLQVWYGPDEKIPSIRRLISSLQTGIGRQWTKALLLSEIRCIVPTCVGFPMETSFYYSSVTKVAGNVQAQITPSPRSDFRLTELLNSNVRLRSKMSLSMAKHMTFVIGINTNMIQAGLEAHTKVNAHVPVNVVATIQMKEKSIKAEIPPCKEETNLIIVSSKTFAVTRNIEDLAASKMTPVLLPEAVPDIMKMSFDSDSASGETDNIRDRQSVEDVSSGNSFSFGHPSSGKEPFIQSMCSNASTFGVQVCIEKKSVHAAFIRNVPLYNAIGEHALRMSFKPVYSDVPIEKIQVTIQAGDQAPTKMVRLVTFEDPERQESSRKEVMKRVKKILDDTDNQATRNSRSSSSSASSISESSESTTSTPSSSDSDNRASQGDPQINLKSRQSKANEKKFYPFGDSSSSGSSSSSSSSSSSSSDSSSSSRSSSSSDSSSSSSSSSSSSSSKSKSSSRSSKSNRSSSSSNSKDSSSSSSKSNSKGSSSSSSKASGTRQKAKKQSKTTSFPHASAAEGERSVHEQKQETQSSSSSSSRASSNSRSTSSSTSSSSESSGVSHRQWKQDREAETKRVKSQFNSHSSYDIPNEWETYLPKVYRLRFRSAHTHWHSGHRTSSSSSSSSSESGSSHSNSSSSDSSSRRSHMSDSSSSSSSHRHGEKAAHSSRRSPTSRAASAHHRPGSSLTRERNFLGDVIPPGITIVAQAVRSDNRNQGYQATAYVRSDAAKVDVQLVVVQLAETNWKACADAVILPLKAQARMRWGKECRDYRIAALATTGQMARKLAVQLKVQWGIIPSWIKKTSTALMRYVPGVALVLGFSEAHQRNPSRELIVRAVATSPRSIDTVIKVPGVTLYYQGLRVPFTLALGASSSSYETRDITAWNFLPEIASQIAQEDQSTCEVSKGDFKTFDRMSFTCSFNKSCNVVVAQDCTEHPKFIITTRKVDHQSLSREVHINTSSANITICPAADSSLLVTCNKESVLSDSGVSEYEKDNIKIYKNGKTVIVEAPIHGLKNVNFDGEILKVTVASWMRGKTCGVCGNNDREKHNELLMPNHKLAHSCSAFVHSWVLLEETCSGGCKLQRRYVKLNRNPTIDGEESTCYSVDPVLKCMKDCTPIEKTSVKVGFHCFPKATAVSLLEWQRSSDKKSASEDVVESVDADIDCTCTGDCS

SEQ ID NO: 1148 - protein, 192 aa, Gallus domesticus (chicken)
MAPKKDVKKPAAAAAPAPAPAPAPAPAPAKPKEPAIDLKSIKIEFSKEQQDDFKEAFLLFDRTGDAKITLSQVGDIVRALGQNPTNAEINKILGNPSKEEMNAKKITFEEFLPMLQAAANNKDQGTFEDFVEGLRVFDKEGNGTVMGAELRHVLATLGEKMTEEEVEELMKGQEDSNGCINYEAFVKHIMSV

SEQ ID NO: 1149 - protein, 110 aa, Gallus domesticus (chicken)
MAMTDVLSAEDIKKAVGAFSAAESFNYKKFFEMVGLKKKSPEDVKKVFHILDKDRSGFIEEEELKFVLKGFTPDGRDLSDKETKALLAAGDKDGDGKIGADEFATMVAES

SEQ ID NO: 1150 - protein, 434 aa, Gallus domesticus (chicken)
MSIQKIHAREILDSRGEPTVEVDLHTAKGHFRAAVPSGASTGIHEALEPRDGDKKRFLGKGVLKAVEHINKTIGPALIEKKISVVEQEKIDKVMIEMDGTENKSKFGANAILGVSLAVCKAGAAEKGVPLYRHIADLAGNTELILPVPAFNVINGGSHAGNKLAMQEFMVLPVGAASFHDAMRVGAEVYHSLKGVIKAKYGKDATNVGGEGGFAPNILDNHEALELLKAAIAQAGYTDKVVIGMDVAASEFCRDGRYHLDFKSPPHTKRYITGEQLGEIYRGFIKDYPVVSIEDPFDQDDWEAWKRFVFHVDIQVVGDDLTVTNPKRIAHGAEQHACNCLLLKVNQIGSVTESIQACKLAQSHGWGVMVSHRSGETEDTFIADLVVGLCTGQIKTGAPCRSERLAKYNQLMRIEEALGDKAKFAGRKFRNPKAK

SEQ ID NO: 1151 - protein, 800 aa, Homo sapiens (human autoallergens)
MGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 1152 - protein, 215 aa, Homo sapiens (human autoallergens)
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1153 - protein, 202 aa, Homo sapiens (human autoallergens)
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 1154 - protein, 476 aa, Homo sapiens (human autoallergens)
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 1155 - protein, 564 aa, Homo sapiens (human autoallergens)
MASTSTTIRSHSSSRRGFSANSARLPGVSRSGFSSVSVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPTIQRVRAEEREQIKTLNNKFASFIDKVRFLEQQNKVLETKWTLLQEQGTKTVRQNLEPLFEQYINNLRRQLDSIVGERGRLDSELRGMQDLVEDFKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRAIGGGLSSVGGGSSTIKYTTTSSSSRKSYKH

SEQ ID NO: 1156 - protein, 109 aa, Lates calcarifer (Barramundi)
MAFAGILNEADITAALAACQAADSFKHKDFFVKVGLAGKSDDDVKKAFAVIDQDKSGFIEEDELKLFLQNFSASARALTDAETKEFLKAGDSDGDGKIGVDEFAALVKV

SEQ ID NO: 1157 - protein, 109 aa, Lates calcarifer (Barramundi)
MAFSNVLSDSDVAAALDGCKDAGTFDHKKFFSACGLSNKTSDDVKKAFAIIDQDKSGFIEEEELKLFLQNFKADARVLTDVETSTFLKAGDTDGDGKIGADEFTALVKP

SEQ ID NO: 1158 - protein, 109 aa, Lepidorhombus whiffiagonis (Megrim, Whiff, Turbot fish)
MTFAGLDAAEIKAALDGCAAADSFDYKKFFGACGLAKKSAEEVKAAFNKIDQDESGFIEEDELKLFLQNFSASARALTDKETANFLKAGDVDGDGKIGIEEFTDLVRSK

SEQ ID NO: 1159 - protein, 172 aa, Mesocricetus auratus (Golden hamster, Syrian hamster)
MVKFLLLALALGVSCAQHQNLEVSPSEVDGKWHSLYIAADNKSKVSEGGPLRVYVKHLECSDECQTFTIKFYTKVENVCQEHRVVGRKGKDGKYITDFSGQNYFHVVEKADDTMTFHNVNVDDSGKTNVILVVGKGESSSIEQKQRFEKTAEKYDIPKENIEHLVTTDTCNQ

SEQ ID NO: 1160 - protein, 180 aa, Mus musculus (mouse)
MKMLLLLCLGLTLVCVHAEEASSTGRNFNVEKINGEWHTIILASDKREKIEDNGNFRLFLEQIHVLENSLVLKFHTVRDEECSELSMVADKTEKAGEYSVTYDGFNTFTIPKTDYDNFLMAHLINEKDGETFQLMGLYGREPDLSSDIKERFAQLCEEHGILRENIIDLSNANRCLQARE

SEQ ID NO: 1161 - protein, 180 aa, Mus musculus (mouse)
MKMLLLLCLGLTLVCVHAEEASSTGRNFNVEKINGEWHTIILASDKREKIEDNGNFRLFLEQIHVLEKSLVLKFHTVRDEECSELSMVADKTEKAGEYSVTYDGFNTFTIPKTDYDNFLMAHLINEKDGETFQLMGLYGREPDLSSDIKERFAKLCEEHGILRENIIDLSNANRCLQARE

SEQ ID NO: 1162 - protein, 193 aa, Oncorhynchus keta (Chum salmon)
SMTDLSPFDDNIVNKIHYLFSEVNAVKCSMVGDTLTTFNNRKYPVNMPLSCYQVLAQDCTIELKFMVLLKKDHASEQNHINVKISDIDVDLYTEDHGVMVKVNEMEISKDNLPYTDPSGSIMIKQKGEGVSLYAKSHGLQEVYFDSNSWKIKVVDWMKGQTCGLCGKADGEHRQEYRTPSGRLTKSSVSFAHS

SEQ ID NO: 1163 - protein, 108 aa, Oncorhynchus mykiss (Rainbow trout)
  misc_feature (39)..(40): Xaa can be any naturally occurring amino acid
  misc_feature (46)..(48): Xaa can be any naturally occurring amino acid
  misc_feature (74)..(76): Xaa can be any naturally occurring amino acid
ACAHLCKEADLKTALEACKAADSFNFKTFFHTLGFASKXXDDVKKXXXVLDQDASGFLEVEELKLFLQNFCPKXXXLTDAETKAFLKAGDADGDGMLGLDEFAVLVKQ

SEQ ID NO: 1164 - protein, 107 aa, Oncorhynchus mykiss (Rainbow trout)
  misc_feature (32)..(37): Xaa can be any naturally occurring amino acid
  misc_feature (45)..(48): Xaa can be any naturally occurring amino acid
  misc_feature (83)..(86): Xaa can be any naturally occurring amino acid
SFAGLNDADVAAALAACAAADSFNHKAFFAKXXXXXXSPDDLKKXXXXLDQDKSGFLEEDELKLFLQNFSASARALTDAETKXXXXAGDADGDGMLGLDEFAVLVKQ

SEQ ID NO: 1165 - protein, 284 aa, Oreochromis mossambicus (Mozambique tilapia)
MDAIKKKMQMLKLDKENALDRAEQAESDKKAAEDRSKQLEDDLVALQKKLKGTEDELDKYSEALKDAQEKLELAEKIATDAEGEVASLNRRIQLVEEELDRAQERLATALTKLEEAEKAADESERGMKVIENRAMKDEEKMELQEIQLKEAKHIAEEADRKYEEVARKLVIIEGDLERTEERAELSEGKCSELEEELKTVTNNLKSLEAQAEKYSQKEDKYEEEIKALTDKLKEAETRAEFAERSVAKLEKTIDDLEDELYAQKLKYKAISEELDHALNDMTSI

SEQ ID NO: 1166 - protein, 93 aa, Oryctolagus cuniculus (rabbit) [sequence omitted]

SEQ ID NO: 1167 - protein, 90 aa, Oryctolagus cuniculus (rabbit)
MKLLVPLLLVALALGCYEADAAACPAFVLDSVGFLFDPKPVYRQKLAKYDAPPEAVEAKLQVKECTDEIDKGKRVLIAAVLTKIVKECAL

SEQ ID NO: 1168 - protein, 172 aa, Oryctolagus cuniculus (rabbit)
ILICAPKRGDAHSHSEVSQISGEWYSVLLASDHREKIEENGSMRVFVEYIHVWKNSSLSFKFHTPVNGKCTELFLTCDPTEDNHVYTVEYDGHNVFSILDMVPDDYIIFHLINHNNGESFQLMELYGRGLDVRSDIREKFVQLCQERGIVEENILDLTKVDRCLYARDGGAA

SEQ ID NO: 1169 - protein, 151 aa, Phodopus sungorus (Siberian hamster)
NDYAELEGKWDTIAIAADNDAKIKEEGPLRLYVRELYCNEDCSEMEVTFYVNANNQCSKTTVIGYKQADGTYRTQFEGDNRFQPVYATPENIVFTSKNVDRAGQETNLIFVVGKSQPLTPEQHEKLVEFAHENNIPEENIHNVLATDTCPK

SEQ ID NO: 1170 - protein, 110 aa, Rana esculenta (edible frog)
MPMTDLLAAGDISKAVSAFAAPESFNHKKFFELCGLKSKSKEIMQKVFHVLDQDQSGFIEKEELCLILKGFTPEGRSLSDKETTALLAAGDKDGDGKIGVDEFVTLVSES

SEQ ID NO: 1171 - protein, 109 aa, Rana esculenta (edible frog)
MSITDIVSEKDIDAALESVKAAGSFNYKIFFQKVGLAGKSAADAKKVFEILDRDKSGFIEQDELGLFLQNFRASARVLSDAETSAFLKAGDSDGDGKIGVEEFQALVKA

SEQ ID NO: 1172 - protein, 109 aa, Rastrelliger kanagurta (Indian Mackerel)
MAFASVLKDAEITAALDGCKADGSFDHKKFFKACGLAGKSGDDVKKAFAIIDQDKSGFIEEEELKLFLQNFKAGARTLSDAETKAFLKAGDTDGDGKIGVDEFAAMIKG

SEQ ID NO: 1173 - protein, 181 aa, Rattus norvegicus (Rat)
MKLLLLLLCLGLTLVCGHAEEASSTRGNLDVAKLNGDWFSIVVASNKREKIEENGSMRVFMQHIDVLENSLGFKFRIKENGECRELYLVAYKTPEDGEYFVEYDGGNTFTILKTDYDRYVMFHLINFKNGETFQLMVLYGRTKDLSSDIKEKFAKLCEAHGITRDNIIDLTKTDRCLQARG

SEQ ID NO: 1174 - protein, 109 aa, Salmo salar (Atlantic salmon)
MACAHLCKEADIKTALEACKAADTFSFKTFFHTIGFASKSADDVKKAFKVIDQDASGFIEVEELKLFLQNFCPKARELTDAETKAFLKAGDADGDGMIGIDEFAVLVKQ

SEQ ID NO: 1175 - protein, 434 aa, Salmo salar (Atlantic salmon)
MSITKIHAREILDSRGNPTVEVDLYTAKGRFRAAVPSGASTGVHEALELRDGDKSRYLGKGTVKAVDHVNKDIAAKLIEKKFSVVDQEKIDHFMLELDGTENKSKFGANAILGVSLAVCKAGAAEKGVPLYRHIADLAGHKDVILPCPAFNVINGGSHAGNKLAMQEFMILPIGASNFHEAMRIGAEVYHNLKNVIKAKYGKDATNVGDEGGFAPNILENNEALELLKTAIEKAGYPDKIIIGMDVAASEFYKAGKYDLDFKSPDDPARYITGDQLGDLYKSFIKGYPVQSIEDPFDQDDWAAWTKFTAAVDIQVVGDDLTVTNPKRIQQAVEKKACNCLLLKVNQIGSVTESIKACKLAQSNGWGVMVSHRSGETEDTFIADLVVGLCTGQIKTGAPCRSERLAKYNQLMRIEEELGAKAKFAGKDYRHPKIN

SEQ ID NO: 1176 - protein, 363 aa, Salmo salar (Atlantic salmon)
MPHAFPFLTPDQKKELSDIALKIVAKGKGILAADESTGSVAKRFQSINTENTEENRRLYRQLLFTADDRAGPCIGGVIFFHETLYQKTDAGKTFPEHVKSRGWVVGIKVDKGVVPLAGTNGETTTQGLDGLYERCAQYKKDGCDFAKWRCVLKITSTTPSRLAIMENCNVLARYASICQMHGIVPIVEPEILPDGDHDLKRTQYVTEKVLAAMYKALSDHHVYLEGTLLKPNMVTAGHSCSHKYTHQEIAMATVTALRRTVPPAVPGVTFLSGGQSEEEASINLNVMNQCPLHRPWALTFSYGRALQASALKAWGGKPGNGKAAQEEFIKRALANSLACQGKYVASGDSAAAGDSLFVANHAY

SEQ ID NO: 1177 - protein, 109 aa, Sardinops sagax (Pacific pilchard)
MALAGLVKEADITAALEACKAADSFDHKAFFHKVGMSGKSADELKKAFAIIDQDKSGFIEEEELKLFLQNFCKKARALTDGETKKFLKAGDNVGDGKIGIDEFNHLVKH

SEQ ID NO: 1178 - protein, 109 aa, Sebastes marinus (Ocean perch, redfish, snapper)
MALAASLNAADITAALAACSGVDTFKHKDFFGKVGLSAKSADDIKNAFKVIDQDKSGFIEEEELKLFLQNFSATARALTEAETTAFLKAGDSDGDGMIGMDEFAAMVKG

SEQ ID NO: 1179 - protein, 110 aa, Sebastes marinus (Ocean perch, redfish, snapper)
MAFASVGLKDADIAAALDGCKDAGKFNHKTFFKTCGLSGKSSDEVKKAFAIIDQDISGFIEEEELKLFLQTFKAGARALSDAETKEFLKAGDSDGDGKIGADEWAAMVKQ

SEQ ID NO: 1180 - protein, 607 aa, Sus scrofa (Domestic pig)
MKWVTFISLLFLFSSAYSRGVFRRDTYKSEIAHRFKDLGEQYFKGLVLIAFSQHLQQCPYEEHVKLVREVTEFAKTCVADESAENCDKSIHTLFGDKLCAIPSLREHYGDLADCCEKEEPERNECFLQHKNDNPDIPKLKPDPVALCADFQEDEQKFWGKYLYEIARRHPYFYAPELLYYAIIYKDVFSECCQAADKAACLLPKIEHLREKVLTSAAKQRLKCASIQKFGERAFKAWSLARLSQRFPKADFTEISKIVTDLAKVHKECCHGDLLECADDRADLAKYICENQDTISTKLKECCDKPLLEKSHCIAEAKRDELPADLNPLEHDFVEDKEVCKNYKEAKHVFLGTFLYEYSRRHPDYSVSLLLRIAKIYEATLEDCCAKEDPPACYATVFDKFQPLVDEPKNLIKQNCELFEKLGEYGFQNALIVRYTKKVPQVSTPTLVEVARKLGLVGSRCCKRPEEERLSCAEDYLSLVLNRLCVLHEKTPVSEKVTKCCTESLVNRRPCFSALTPDETYKPKEFVEGTFTFHADLCTLPEDEKQIKKQTALVELLKHKPHATEEQLRTVLGNFAAFVQKCCAAPDHEACFAVEGPKFVIEIRGILA

SEQ ID NO: 1181 - protein, 109 aa, Thunnus albacares (Yellowfin tuna)
MAFAGILTEADITAALAACQAADSFKYKDFFTKVGLAAKTPEDIKKAFAVIDQDKSGFIEEDELKLFLQNFSAGARALTDAETKAFLMAGDSDGDGKIGIDEFAALVKA

SEQ ID NO: 1182 - protein, 12 aa, Thunnus albacares (Yellowfin tuna)
SITKIKAREILD

SEQ ID NO: 1183 - protein, 37 aa, Thunnus albacares (Yellowfin tuna)
PHAFPFLTPEQKKELSDIAHKIVAPGKGILAADESTG

SEQ ID NO: 1184 - protein, 109 aa, Xiphias gladius (Swordfish)
MAFAGVLSDADVAAALEACKDAGTFDYKKFFKSCGLAAKSTDDVKKAFAIIDQDKSGFIEEDELKLFLQNFKAAARPLTDAETEAFLKAGDSDGDGKIGAEEFAALVTA

SEQ ID NO: 1185 - protein, 284 aa, Crassostrea gigas(Pacific Oyster)
MDSIKKKMIAMKMEKENAQDRAEQLEQQLRDTEEQKAKIEEDLTSLQKKHSNLENEFDTVNEKYQECQTKMGEAEKTASEAEQEIQSLNRRIQLLEEDMERSEERLQTATEKLEEASKAADESERNRKVLENLNNASEERTDVLEKQLTEAKLIAEEADKKYDEAARKLAITEVDLERAEARLEAAEAKVLELEEELKVVGNNMKSLEISEQEASQREDSYEETIRDLTQRLKDAENRATEAERTVSKLQKEVDRLEDELLAEKERYKAISDELDQTFAELAGY

SEQ ID NO: 1186 - protein, 284 aa, Crassostrea gigas(Pacific Oyster)
MDSIKKKMIAMKMEKENAQDRAEQLEQQLRDTEEQKAKIEEDLTSLQKKHSNLENEFDTVNEKYQECQTKLEEAEKTASEAEQEIQSLNRRIQLLEEDMERSEERLQTATEKLEEASKAADESERNRKVLENLNNASEERTDVLEKQLTEAKLIAEEADKKYDEAARKLAITEVDLERAEARLEAAEAKVYELEEQLSVVANNIKTLQVQNDQASQREDSYEETIRDLTQRLKDAENRATEAERTVSKLQKEVDRLEDELLAEKERYKAISDELDQTFAELAGY

SEQ ID NO: 1187 - protein, 284 aa, Haliotis laevigata x Haliotis rubra (Jade tiger abaolone)
MDAIKKKMLAMKMEKENAVDRAEQNEQKLRDTEEQKAKIEEDLNNLQKKCANLENDFDNVNEQLQEAMTKLETSEKRVTEMEQEVSGTTRKITLLEEDLERNEERLQTATERLEEASKAADESERGRKVLESRSLADDERIDQLEAQLKEAKYIAEDAERKYDEAARKLAITEVDLERAEARLEAAEAKILELEEELKVVGNNMKSLEISEQEASQREDSYEETIRDLTQRLKDAENRATEAERTVSKLQKEVDRLEDELLAEKEKYKAISDELDQTFAELAGY

SEQ ID NO: 1188 - protein, 284 aa, Helix aspersa (Brown garden snail)
MDAIKKKMLAMKMEKENALDRAEQVEQKLRDCECNKNKVEEDLNNLQKKFAILENDFDSINEQLLDANTKLEASEKKNAEIESETAGLQRRIQLLEEDLERSEERLQSATEKLEEASKAADESERGRKVLESRSLADDERLDGLEAQLKEAKYIAEDAERKFDEAARKLAITEVDLERAEARLEAAEAKILELEEELKVVGNNMKSLEISEQEASQREDSYEETIRDLTQRLKDAENRASEAERTVSKLQKEVDRLEDELLAEKERYKATSDELDSTFAELAGY

SEQ ID NO: 1189 - protein, 194 aa, Anisakis simplex (Herring worm)
MASMQHFSLAALLLAASICLGDADRTECQLPLDKGTPCTQEGGVKPSVAWWHDDKSGICLSFKYTGCGGNANRFTTIKNCEQHCKMPDRGACALGKKPAEDSNGEQLVCAGMREDKCPNGYQCKMMAFMGLCCPTKEEELFAREYEGVCKSGKPVKMDRGSGWMMTILGKSCDDQFCPEDAKCERGKLFANCCK

SEQ ID NO: 1190 - protein, 869 aa, Anisakis simplex (Herring worm)
MSDTLYRSPSMAIRSSTADMGALTSMSVADLGSLTRLEDKIRLLQDDFESERELRNRIERERADLSVQLIALTDRLQDAECATDSQIESNRKREVELSKLRKLLEESQLENEDAMNVLRKKHQDVCLDYTEQIEQLQKKNSKIDRERQRLQHEVIELTATIDQLQKDKHVAEKMAQKFEQQTIELSNKVEDLNKHVNDLAQQRQRLQAENSDLLAEIHDQKVQLDNLQHVKYQLAQQLEESRRRLEDAERERSQMQAQLHQVQLELDSVRVALDEESAARVEAEHKLSLANTEITQWKSKFDAEVALHHEEVEDLRKKMMQKQAEYEEQIEIMLQKVSQLEKAKARLQSEVEVLIVDLEKAQNTIAILERAKEQLEKQVLEMKSRIDELLVELEAAQREARAALAELQKMKQLYEKAVEQKEALARENKKLQDDLHEANEALADANRKLHELDLENARLAGEIRDLQVALKESEAARRDAEARAQRALAELQQVRIEMERRLQEKEEEMEALRKSMQFEIDRLTAALADAEARMKAEIARLRKKYQAEIAELEMTVDNLNRANLEAQKTIKKQSEQIIQLQANLEDTQRQLQQTLDQYALAQRKISALSAELEECKTALDNAIRARKQAEADLEEAHVRISDLTSINSNLTAIKNKLETELSTAQADLDEVTKELHAADERANRALADAARAVQELHEEQEHSMKIDALRKSLEEQVKQLQVQIQEAEAAALLGGKRVIAKLETRIRDLEVALDEETRRHKETQSALRKKDRRIKEVQMQIDEEHKMFVMAQDTADRMLEKLNIQKRQLGEAEAMTMQNLQRVRRYQRELEDAEGRADQAESSLNLIRAKHRGTVAVGKATDVYVVEED

SEQ ID NO: 1191 - protein, 284 aa, Anisakis simplex (Herring worm)
MDAIKKKMQAMKIEKDNALDRADAAEEKVRQMTDKLERIEEELRDTQKKMMQTENDLDKAQEDLSTANSNLEEKEKKVQEAEAEVAALNRRMTLLEEELERAEERLKLATAKLEEATHTADESERVRKVMENRSFQDEERANTVESQLKEAQMLAEEADRKYDEVARKLTMVEADLERAEERAETGENKIVELEEELRVVGNNLKSLEVSEEKALQREDSYEEQIRTVSARLKEAETRAEFAERSVQKLQKEVDRLEDELVHEKERYKSISEELDQTFQELSGY

SEQ ID NO: 1192 - protein, 115 aa, Anisakis simplex (Herring worm)
MQSRIVVAVVVFCCIILMQTEAGMLGGSSDVDVNDPEIKELAGKSIAKISAMINDGKPHELVKVVSAKKQVVAGDKYTLEILVKDGDHQDLCTVTIWQKKWENFEEVKVLKCDHQ

SEQ ID NO: 1193 - protein, 152 aa, Anisakis simplex (Herring worm)
MKTLIVAALFCTIGMALADDTPPPPPFLAGAPQDVVKAFFELLKKDETKTDPEIEKDLDAWVDTLGGDYKAKFETFKKEMKAKEAELAKAHEEAVAKMTPEAKKADAELSKIAEDDSLNGIQKAQKIQAIYKTLPQSVKDELEKGIGPAVPQ

SEQ ID NO: 1194 - protein, 84 aa, Anisakis simplex (Herring worm)
MFQSTFFLVLMVCVATARFANKDHCPPNEEYNECGNPCQEKCDNGEPVICTYQCEHRCFCKQGYVRLTEDGECVPEEFCKPIHY

SEQ ID NO: 1195 - protein, 1096 aa, Anisakis simplex (Herring worm)
AKYGSQFCKNLLANCLSSTGATLPMQSPWQIPPVVSSCITSGMAKGTDHNKKDVMATCIQRYGADFCKNMVGSCAALTDVTLTSYGIGSVLPQVIVDCMTSEMSSPSIMWQCVQKYGTEFCKKLLQDCSASTGASLSPQAPWLIPSVIAECMAKGMVNGGRQADDTMAICIQKYGIKFCNIIGAACSVLTQVPFFPQLPGTVQQLPSELRACVRSETQKPNVMTKCVEKYGTEFCSSLLQSCSASTGAILPLREPWKIPHPIADCMYAGMNPESKEDRGGIMSKCIRRYGFDFCKKMLESCSALTSVQHDSRNTNYASLPQVLKDCMASEMDSPSVMFECVQRYGTPFCKGLLETCTEKTRASLSPQAPWLIPTAIAQCMRQGMNQGDEKKTLMSLCVRRYGADYCNNLAAACSVLTNLPFFPQTPPSEQNLPPMMHKCLKSEMENPGIMSTCVQRYGTQFCKNLLNSCTASTGMHLPYDAPWKIPEPIAACMAQGMNGGDHKPKEDAMARCIRKYGVTYCNNMLASCSVLTNVNYDPSGGQMPGILSECVTAETDEPSAMCQCVQKYGTEFCKKRLASCIASTGMNLPATTPWKLPPPVARCMQHGSPNDNRGQGQGSNDVMSQCIARYGAEFCQRLARFCYAMNSLQYPGETFDPQQQTPTQVARCMKSEMDSPSVMWHCVQKYGQEFCNKLAATCSTETNTPLPQQDPWRLPQPIIACMLGKMNNPNPTSKPQSVMSQCTARYGDDFCLSLGKACAELNNVPSSMISLSAQQLPQPVSSCMKAEMNNPSALWQCIQQYGIEFCKKLRDACSAMTGASLSTTTPWILPQPVSNCMRNEMNNPSAMWLCIQKYGIEFCNRLASACAMIKKVTMPTVTINLPEIIASCVASENSQAMCYARKGPEQCKTEENICRNPNNPPGSPLTIPETECMKSQVAMATCQKKFGSECVALQQECVAGTGAPPVTIGARGAFMLATALRSCIFNGGVIGSCVLYHPPSQCDQWVQQCATALQTSAGVTVAGGYRQLSPPMAVCVASQDLMTRCMTRLGQGTCQQAVKNCKRRFNTPSSRLPGRLWSLSSELINCLYRPVNRASN

SEQ ID NO: 1196 - protein, 150 aa, Anisakis simplex (Herring worm)
MKVLFFVAAVVAVSLAQDQGPPPLPKFLDGADQATKDAFAALAQTFKDDTDKQVEDAVQQFVNDHPAIKDAYEAEKKEVLAAQQAAEEEHKKLVAALPPDAQKADAELTAIADDASLTLAAKHDKIVQTFESLPPAVKEELNKLNQQGQS

SEQ ID NO: 1197 - protein, 147 aa, Anisakis simplex (Herring worm)
MKLCILAVAVFVVAVSAQGPPPLPPFVANAPPAVQAEFRQLANGAPDKTEAEIEAQIEQWVASKGGAVQAEFNKFKQMLEQGKARAEAAHQASLTRLSPAAKAADARLSAIASNRALKVGEKQRQLAAAFQALDPAVKAELQKEMQG

SEQ ID NO: 1198 - protein, 231 aa, Anisakis simplex (Herring worm)
MHLITALVLLLQLIHFITSSPIPQEVVGGPGPVVGGSGIGNVWEKANEQAAEQQNIGGPGPVISGSGIGDVWNKANEPAEQQENIGGPGPVVSGSGIGNVWEKANEQAAHQQSIEGPGPVVSGSGIGNVWEKANEQAAHQQSIEGPGPVVSGSGIGDVWNKANEQAAEQQNIGGPGPVISGSGIGNVWEKANEQAAEQQNIGVGGPGPVKSGSGIGNVWEETNEEAASMQA

SEQ ID NO: 1199 - protein, 307 aa, Anisakis simplex (Herring worm)
MHSTAILLLVLQLSCYFAASFILPGGANPPRFPVGGPGPIISGDGVNVWQKANSIPKLKDNAGQRQVNIPPPFIRGPGPVVSGSGIGEVGQIPIGGPGPVVSGSGIGQVFPPQSGQLPIGGPGPVVSGSGIGGGANPPRFPVGGPGPIISGDGVNVWQKANSIPKLKDNAGQRQVNIPPPFIRGPGPVVSGSGIGEVGQIPIGGPGPVVSGSGIGQVFPPQSGQLPIGGPGPVVSGSGIGGGANPPRFPVGGPGPIISGDGVNVLQKANSIPKLKGNANPPQLPVGGPGPVISVDGESVLQKEENSL

SEQ ID NO: 1200 - protein, 295 aa, Anisakis simplex (Herring worm)
MLSHLWLIQLCIVAVLSNSEREEFAFLCPVVKNLPPSVREQCIESQIVIRDCKEKKYGENCAELIKQCVTITGAPPVTIGGSGQYRVASSLRDCIKKGGYMGYCSNFTTHENCIKWKDECAPSEAAEKKDENSLEVFPETFSQCFKSQVVMQQCMNEGEEECSKIEKECVDALGTPPVTTAANGAYQMAAPLHRCIENGGWMKMCSTWINATICERWKQECSRDKDAEPPTNFSQCIQTQTVMLQCKLEFGDKCKALQEECVAATYAPTAYVDANPPIFTSETIRCVQRKMAKGL

SEQ ID NO: 1201 - protein, 309 aa, Anisakis simplex (Herring worm)
ELCMKSLEHAKVGSSKEAKQDGVDLYKHMFEHYPVMKKYFKHREGYTAADVQKDPLFIKQGQNILLACHVVCATYDDRETFDAYTHELMARHERDHVRIPNDVWAHFWEHFNMYLAEKTTMDEPTKQAWLEIGKEFSSEITKYGRPTVRDHCMSSLEHIAIGDEAHQKQNGVDLYKHMFEHYPHMRLAFKGRENYTAEDVQKDEFFVKQGHKILLALRMFCTSYDDEPTFDFFVDALLDRHIKDDIHLPQAQWHEFWKLFAEYLDQKSHSHLTEDEKHSWTTIGEEFGHEADKHAKAGHHEGEHKEEHH

SEQ ID NO: 1202 - protein, 217 aa, Anisakis simplex (Herring worm)
MQVKCIAKYGEQFCSSMLSVCSSMLSIPWKNDSVQRLPPGIVGCAQTTDPVVQCRAKYSESFCNRLGAACSKVTGTDIPAFSRGGGEYRLPEAISQCIAQENIVAMCYASKCSQQCDGWRVTCNINGGMAQLTPEQVTCFEKQSGLVALKTSCRTNPLNAQCRQIREPFETPKCTTAIPYLKISQTVINGQIHVQQLVSGGMTGVQVSKTVETVIKT

SEQ ID NO: 1203 - protein, 287 aa, Ascaris lumbricoides (Common roundworm)
MDAIKKKMQAMKIEKDNALDRADAAEEKVRQMTDKLERIEEELRDTQKKMMQTENDLDKAQEDLSVANSNLEEKEKKVQEAEAEVAALNRRMTLLEEELERAEERLKLATEKLEEATHTADESERVRKVMENRSFQDEERANTVESQLKEAQMLAEEADRKYDEVARKLAMVEADLERAEERAEAGENKIVELEEELRVVGNNLKSLEVSEEKALQREDSYEEQIRTVSARLKEAETRAEFAERSVQKLQKEVDRLEDELVHEKERYKSISEELDQTFQELSGYRSD

SEQ ID NO: 1204 - protein, 206 aa, Ascaris lumbricoides (Common roundworm)
MPQYKLTYFDIRGLGEGARLIFHQAGVKFEDNRLKREDWPALKPKTPFGQLPLLEVDGEVLAQSAAIYRYLGRQFGLAGKTPMEEAQVDSIFDQFKDFMAELRPCFRVLAGFEEGDKEKVLKEVAVPARDKHLPLLEKFLAKSGSEYMVGKSVTWADLVITDSLASWESLIPDFLSGHLQLKKYIEHVRELPNIKKWIAERPKTPY

SEQ ID NO: 1205 - protein, 1365 aa, Ascaris suum (Pig roundworm)
TMEHYLKTYLSWLTEEQKEKLKEMKEAGKTKAEIQHEVMHYYDQLHGEEKQQATEKLKVGCKMLLKGIIGEEKVVELRNMKEAGADIQELQQKVEKMLSEVTDEKQKEKVHEYGPACKKIFGATTLQHHRRRRHHFTLESSLDTHLKWLSQEQKDELLKMKKDGKTKKELEAKILHYYDELEGDAKKEATEHLKGGCGEILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKAKKELEAKILHYYDELEGDAKKEATEHLKGGCAEILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKTKKDLQAKILHYYDELEGDAKKEATEHLKDGCREILKHVVGEEKEAELKKLKDSGASKEEVKAKVEEALHAVTDEEKKQYIADFGPACKKIFGAAHTSRRRRHHFTLESSLDTHLKWLSQEQKDELLKMKKDGKAKKELEAKILHYYDELEGDAKKEATEHLKGGCREILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKAKKELEAKILHYYDELEGDAKKEATEHLKGGCREILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKAKKELEAKILHYYDELEGDAKKEATEHLKGGCREILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKAKKELEAKILHYYDELEGDAKKEATEHLKGGCREILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKAKKELEAKILHYYDELEGDAKKEATEHLKGGCREILKHVVGEEKAAELKNLKDSGASKEELKAKVEEALHAVTDEEKKQYIADFGPACKKIYGVHTSRRRRHHFTLESSLDTHLKWLSQEQKDELLKMKKDGKAKKELEAKILHYYDELEGDAKKEATEHLKGGCREILKHVVGEEKAAELKNLKDSGASKEELKAKVEEALHAVTDEEKKQYIADFGPACKKIYGVHTSRRRRYHAEDGTDDIDGLAQSRQRRSGFFEKLIDVFAFF

SEQ ID NO: 1206 - protein, 157 aa, Alternaria alternata (Alternaria plant rot fungus)
MQFTTIASLFAAAGLAAAAPLESRQDTASCPVTTEGDYVWKISEFYGRKPEGTYYNSLGFNIKATNGGTLDFTCSAQADKLEDHKWYSCGENSFMDFSFDSDRSGLLLKQKVSDDITYVATATLPNYCRAGGNGPKDFVCQGVADAYITLVTLPKSS

SEQ ID NO: 1207 - protein, 157 aa, Alternaria alternata (Alternaria plant rot fungus)
MQFTTIASLFAAAGLAAAAPLESRQDTASCPVTTEGDYVWKISEFYGRKPEGTYYNSLGFNIKATNGGTLDFTCSAQADKLEDHKWYSCGENSFMNFSFGSDRSGLLLKQKVSDDITYVATATLPNYCRAGGNGPKDFVCQGVADAYITLVTLPKSS

SEQ ID NO: 1208 - protein, 152 aa, Alternaria alternata (Alternaria plant rot fungus)
KTNKIVITNDKGRLSKEEIERMLAEAEKYKAEDEAEAARISAKNALESYAYSLRNTLSDSKVDEKLDAGDKQKLTAEIDKTVQWLDDNQTATKDEYESQQKELEGVANPIMMKFYGAGGEGGMPGGMPGGGMPGGAPGGAAGDDGPTVEEVD

SEQ ID NO: 1209 - protein, 436 aa, Alternaria alternata (Alternaria plant rot fungus)
ARDMTKQALPAVSEVTKDTLEEFKTADKVVLVAYFAADDKASNETFTSVANGLRDNFLFGATNDAALAKAEGVKQPGLVCTSPSTTARTSSPRPSMRTYPRLRKVASTPLIGEVGPETYAGYMAAGIPLAYIFAETPEEREEFAKELKPLALKHKGEINFATIDAKSFGQHAGNLNLKVGTWPAFAIQRTEKNEKFPTNQEAKITEKEIGKFVDDFLAGKIDPSIKSEPIPESNDGPVTVVVAHNYKDVVIDNDKDVLVEFYAPWCGHCKALAPKYEELGQLYASDELSKLVTIAKVDATLNDVPDEIQGFLPSSLFPLARRMPQSTTLVPHCRGSRPVHRRERLTQASASVGEAVEDATESAKASASSATDSAASAVSEGTETVKSGASVASDSASSAASEATKSVKSAASEVTNSASSAASEASASASSVKDEL

SEQ ID NO: 1210 - protein, 113 aa, Alternaria alternata (Alternaria plant rot fungus)
MKHLAAYLLLGLGGNTSPSAADVKAVLESVGIEADSDRLDKLISELEGKDINELIASGSEKLASVPSGGAGGAAASGGAAAAGGSAQAEAAPEAAKEEEKEESDEDMGFGLFD

SEQ ID NO: 1211 - protein, 438 aa, Alternaria alternata (Alternaria plant rot fungus) [sequence omitted]

SEQ ID NO: 1212 - protein, 204 aa, Alternaria alternata (Alternaria plant rot fungus)
MAPKIAIVYYSMYGHIKKMADAELKGIQEAGGDAKLFQVAETLPQEVLDKMYAPPKDSSVPVLEDPAVLEEFDGILFGIPTRYGNFPAQFKTFWDKTGKQWQQGAFWGKYAGVFVSTGTLGGGQETTAITSMSTLVDHGFIYVPLGYKTAFSMLANLDEVHGGSPWGAGTFSAGDGSRQPSELELNIAQAQGKAFYEAVAKAHQ

SEQ ID NO: 1213 - protein, 266 aa, Alternaria alternata (Alternaria plant rot fungus)
MPISVPQATELKDLFSLKGKVVIVTGASGPTGIGTEAARGCAEYGADLAITYNSRAEGAEKNAKEMSEKYGVKVKAYKCQVNEYAQCEKLVQDVIKDFGKVDVFIANAGKTADNGILDATVEQWNEVIQTDLTGTFNCARAVGLHFRERKTGSLVITSSMSGHIANFPQEQASYNVAKAGCIHLAKSLANEWRDFARVNSISPGYIDTGLSDFVPQDIQKLWHSMIPMGRDAKATELKGAYVYFASDASSYCTGSDLLIDGGYCVR

SEQ ID NO: 1214 - protein, 497 aa, Alternaria alternata (Alternaria plant rot fungus)
MTSVKLSTPQTGEFEQPTGLFINNEFVKAVDGKTFDVINPSTEEVICSVQEATEKDVDIAVAAARKAFNGPWRKETPENRGKLLNKLADLFEKNADLIAAVEALDNGKAFSMAKNVDVPAAAGCLRYYGGWADKIEGKVVDTAPDSFNYIRKEPIGVCGQIIPWNFPILMWSWKIGPAIATGNTVVLKTAEQTPLSAYIACKLIQEAGFPPGVINVITGFGKIAGAAMSAHMDIDKIAFTGSTVVGRQIMKSAAGSNLKKVTLELGGKSPNIVFADADLDEAIHWVNFGIYFNHGQACCAGSRIYVQEEIYDKFIQRFKERAAQNAVGDPFAADTFQGPQVSQLQFDRIMGYIEEGKKSGATIETGGNRKGDKGYFIEPTIFSNVTEDMKIQQEEIFGPVCTISKFKTKADVIKIGNNTTYGLAAAVHTSNLTTAIEVANALRAGTVWVNSYNTLHWQLPFGGYKESGIGRELGEAALDNYIQTKTVSIRLGDVLFG

SEQ ID NO: 1215 - protein, 110 aa, Alternaria alternata (Alternaria plant rot fungus)
MSTSELATSYAALILADDGVDITADKLQSLIKAAKIEEVEPIWTTLFAKALEGKDVKDLLLNVGSGGGAAPLPEALLLRWRAADAAPAAEEKKEEEKEESDEDMGFGLFD

SEQ ID NO: 1216 - protein, 231 aa, Alternaria alternata (Alternaria plant rot fungus)
MSDKPSELAVQKLVLFAVKGTATSTHNTVRPLILLDELGVPHEIYVVDRVSAPWFTEINPHRMVPVILEKSPDGRDTLRAWESTSTLMYIADAYDKDGTFGGRNVQESSDINNWLTLHTAALGPTAKYWLYFYKLHPEKLPKTIEKLRSNITVQYDILERRLNEPGQQYLAWLNEKFKRSSYNRRHCYASLCYEKYRRVVRAGVKVAQTARVVCPYGGDTRRGVWPARKST

SEQ ID NO: 1217 - protein, 25 aa, Alternaria alternata (Alternaria plant rot fungus)
FNAGGHINHSLFWQNLAPASSNEAK

SEQ ID NO: 1218 - protein, 507 aa, Alternaria alternata (Alternaria plant rot fungus)
PQRQMDSAKEVPNSYMVVFKKHVKDASKHHDWVQSVHSKNNEERMELRKRSSQFPVTTEVFDGLKHVYEMAGMKGYSGHFDDETIEAIRNHPDVDYIERDSEVHTLGHDEPEIEKNSPWGLARISHRDSLSFGTWNKYLYAADGGEGVDVYVIDTGTNTKHVDFEGRAKWGKTIPNGDADEDGNGHGTHCSGTVAGKKYGVAKKAHVYAVKVLRSNGSGTMSDVVKGVEYAAKAHSDTVQAAKDGKKKGFKGSAANMSLGGGKSTTLDLAVNAAVDAGIHFAVAAGNDNADSCNYSPAAAENAVTVGASTLLDERAYFSNYGKCNDIFAPGLNILSTWIGSEHATNTISGTSMASPHIAGLLAYMLSLQPAKDSAYAVADITPKKLKANLISVATVGALSDVPRNTKNILAWNGGGSSNYTEIVEKGGYTVKKAAEKNEEESEFRITIPSLSEIEDDFEKAKESAGRNAHRVGGKLQHLEAEIEDFIAEEMESMFEKVKERVASQKL

SEQ ID NO: 1219 - protein, 176 aa, Aspergillus fumigatus (Common mold)
MVAIKNLFLLAATAVSVLAAPSPLDARATWTCINQQLNPKTNKWEDKRLLYSQAKAESNSHHAPLSDGKTGSSYPHWFTNGYDGNGKLIKGRTPIKFGKADCDRPPKHSQNGMGKDDHYLLEFPTFPDGHDYKFDSKKPKEDPGPARVIYTYPNKVFCGIVAHQRGNQGDLRLCSH

SEQ ID NO: 1220 - protein, 310 aa, Aspergillus fumigatus (Common mold)
MAALLRLAVLLPLAAPLVATLPTSPVPIAARATPHEPVFFSWDAGAVTSFPIHSSCNATQRRQIEAGLNEAVELARHAKAHILRWGNESEIYRKYFGNRPTMEAVGAYDVIVNGDKANVLFRCDNPDGNCALEGWGGHWRGANATSETVICDRSYTTRRWLVSMCSQGYTVAGSETNTFWASDLMHRLYHVPAVGQGWVDHFADGYDEVIALAKSNGTESTHDSEALQYFALEAYAFDIAAPGVGCAGESHGPDQGHDTGSASAPASTSTSSSSSGSGSGATTTPTDSPSATIDVPSNCHTHEGGQLHCT

SEQ ID NO: 1221 - protein, 168 aa, Aspergillus fumigatus (Common mold)
MSGLKAGDSFPSDVVFSYIPWSEDKGEITACGIPINYNASKEWADKKVILFALPGAFTPVCSARHVPEYIEKLPEIRAKGVDVVAVLAYNDAYVMSAWGKANQVTGDDILFLSDPDARFSKSIGWADEEGRTKRYALVIDHGKITYAALEPAKNHLEFSSAETVLKHL

SEQ ID NO: 1222 - protein, 322 aa, Aspergillus fumigatus (Common mold)
MQLKNSMLLLTALAAGSSVARLHGHERRHLHHAGEKREVGDTVYATINGVLVSWINEWSGEAKTSDAPVSQATPVSNAVAAAAAASTPEPSSSHSDSSSSSGVSADWTNTPAEGEYCTDGFGGRTEPSGSGIFYKGNVGKPWGSNIIEVSPENAKKYKHVAQFVGSDTDPWTVVFWNKIGPDGGLTGWYGNSALTLHLEAGETKYVAFDENSQGAWGAAKGDELPKDQFGGYSCTWGEFDFDSKINQGWSGWDVSAIQAENAHHEVQGMKICNHAGELCSIISHGLSKVIDAYTADLAGVDGIGGKVVPGPTRLVVNLDYKE

SEQ ID NO: 1223 - protein, 634 aa, Aspergillus fumigatus (Common mold)
MRGLLLAGALALPASVFAHPAHQSYGLNRRTVDLNAFRLKSLAKYVNATETVIEAPSSFAPFKPQSYVEVATQHVKMIAPDATFRVVDDHYVGDNGVAHVHFRQTANGLDIDNADFNVNVGKDGKVFSYGNSFYTGQIPSSAALTKRDFSDPVTALKGTTNTLQLPITVDSASSESTEEKESYVFKGVSGTVSDPKAKLVYFVKDDGTLALAWRVETDIDSNWLLTYIDAKSGEEIHGVVDYVAEADYQVYAWGINDPTEGERTVIKDPWDSVASEFTWISDGSTNYTTSRGNNGIAQSNPSGGSSYLNNYRPSSSSLSFKYPYSVSSSPPSSYIDASIIQLFYTANIYHDLLYTLGFTEKAGNFEYNTNGQGGLGNDYVILNAQDGSGTNNANFATPPDGQPGRMRMYVWTESTPYRDGSFEAGIVIHEYTHGLSNRLTGGPANSNCLNALESGGMGEGWSDFMATAIRLKPGDKRSTDYTMGEWASNRAGGIRQYPYSTSLSTNPLTYTSVNSLNAVHAIGTVWASMLYEVLWNLIDKHGKNDAPKPTLRDGVPTDGKYLAMKLVMDGMALQPCNPNFVQARDAILDADTALTGGENQCEIWTAFAKRGLGAGAKYSSRNRVGSTEVPSGVC

SEQ ID NO: 1224 - protein, 210 aa, Aspergillus fumigatus (Common mold)
MSQQYTLPPLPYPYDALQPYISQQIMELHHKKHHQTYVNGLNAALEAQKKAAEANDVPKLVSVQQAIKFNGGGHINHSLFWKNLAPEKSGGGKIDQAPVLKAAIEQRWGSFDKFKDAFNTTLLGIQGSGWGWLVTDGPKGKLDITTTHDQDPVTGAAPVFGVDMWEHAYYLQYLNDKASYAKGIWNVINWAEAENRYIAGDKGGHPFMKL

SEQ ID NO: 1225 - protein, 270 aa, Aspergillus fumigatus (Common mold)
MAPIFKSLALVSALFAAISSAAPVNLDKREVDVVWTTVTTVVWTTIDVTTTIYPTPQAPTPPVVESTPTPTPSAAPEQAEPIETSTQPETTKSQPTQPSVATFIPVAAAAAAADSAAPIPEEPAPQPATTAAPSTSTTTQAAPSAPPAANSGSTEKAASSGYSGPCSKGSPCVGQLTYYDTATSASAPSSCGLTNDGFSENVVALPVGIMTDADCGKTVTITYNGITKTATVVDKCMGCKPTDLDASRHLFGELADFSAGRIDGMSWYFN

SEQ ID NO: 1226 - protein, 111 aa, Aspergillus fumigatus (Common mold)
MKHLAAYLLLALAGNTSPSSEDVKAVLSSVGIDADEERLNKLIAELEGKDLQELIAEGSTKLASVPSGGAAAAAPAAAGAAAGGAAAPAAEEKKEEEKEESDEDMGFGLFD

SEQ ID NO: 1227 - protein, 395 aa, Aspergillus fumigatus (Common mold)
MYFKYTAAALAAVLPLCSAQTWSKCNPLEKTCPPNKGLAASTYTADFTSASALDQWEVTAGKVPVGPQGAEFTVAKQGDAPTIDTDFYFFFGKAEVVMKAAPGTGVVSSIVLESDDLDEVDWEVLGGDTTQVQTNYFGKGDTTTYDRGTYVPVATPQETFHTYTIDWTKDAVTWSIDGAVVRTLTYNDAKGGTRFPQTPMRLRLGSWAGGDPSNPKGTIEWAGGLTDYSAGPYTMYVKSVRIENANPAESYTYSDNSGSWQSIKFDGSVDISSSSSVTSSTTSTASSASSTSSKTPSTSTLATSTKATPTPSGTSSGSNSSSSAEPTTTGGTGSSNTGSGSGSGSGSGSSSSTGSSTSAGASATPELSQGAAGSIKGSVTACALVFGAVAAVLAF

SEQ ID NO: 1228 - protein, 395 aa, Aspergillus fumigatus (Common mold)
MVVFSKVTAVVVGLSTIVSAVPVVQPRKGFTINQVARPVTNKKTVNLPAVYANALTKYGGTVPDSVKAAASSGSAVTTPEQYDSEYLTPVKVGGTTLNLDFDTGSADLWVFSSELSASQSSGHAIYKPSANAQKLNGYTWKIQYGDGSSASGDVYKDTVTVGGVTAQSQAVEAASHISSQFVQDKDNDGLLGLAFSSINTVSPRPQTTFFDTVKSQLDSPLFAVTLKYHAPGTYDFGYIDNSKFQGELTYTDVDSSQGFWMFTADGYGVGNGAPNSNSISGIADTGTTLLLLDDSVVADYYRQVSGAKNSNQYGGYVFPCSTKLPSFTTVIGGYNAVVPGEYINYAPVTDGSSTCYGGIQSNSGLGFSIFGDIFLKSQYVVFDSQGPRLGFAPQA

SEQ ID NO: 1229 - protein, 178 aa, Aspergillus fumigatus (Common mold)
FHQTPSAMSQVFFDVEYAPVGTAETKVGRIVFNLFDKDVPKTAKNFRELCKRPAGEGYRESTFHRIIPNFMIQGGDFTRGNGTGGRSIYGDKFADENFSRKHDKKGILSMANAGPNTNGSQFFITTAVTSWLDGKHVVFGEVADEKSYSVVKEIEALGSSSGSVRSNTRPKIVNCGEL

SEQ ID NO: 1230 - protein, 706 aa, Aspergillus fumigatus (Common mold)
MSSETFEFQAEISQLLSLIINTVYSNKEIFLRELISNASDALDKIRYQSLSDPTKLDTGKDLRIDIIPDKENKTLTIRDTGIGMTKADLINNLGTIARSGTKQFMEALSAGADISMIGQFGVGFYSAYLVADRVTVVSKNNDDEQYIWESAAGGTFTLTQDTEGEQLGRGTKIILHLKDEQTDYLNESRIKEVVRKHSEFISYPIYLHVLKETEKEVPDEEAEETKEEEDEEKKAKIEEVDDEEEEEKKKKKKTKTVKESKIEEEELNKTKPIWTRNPADITQEEYASFYKSLSNDWEDHLAVKHFSVEGQLEFRAILYVPKRAPFDLFETKKTKNNIKLYVRRVFITDDATDLIPEWLGFIKGVVDSEDLPLNLSRETLQQNKIMKVIKKNIVKKTLELFNEIAEDREQFDKFYSAFSKNIKLGIHEDAQNRQTLAKLLRYQSTKSGDEATSLADYVTRMPEHQKQIYYITGESIKAVAKSPFLDSLKQKNFEVLFLVDPIDEYAFTQLKEFDGKKLVDITKDFELEETEEEKAEREKEEKEYENLAKSLKNILGDKVEKVVVSHKLVGSPCAIRTGQFGWSANMERIMKAQALRDTSMSSYMSSKKTFEISPKSSIIKELKKKVEADGENDRTVKSITQLLFETSLLVSGFTIEEPASFAERIHKLVSLGLNIDEEAETTEEKATEEAAPAEATTGESAMEEVD

SEQ ID NO: 1231 - protein, 403 aa, Aspergillus fumigatus (Common mold)
MLSIKRTLLLLGAVLPAVFGAPVQETRRAAQKIPGKYIVTFKPGTDTATIESHTLWATDLHKRNLERRDTTSGEPPVGIEKSYKIKDFAAYAGSFDDATIEEIRKSADVAHVEEDQIWYLDALTTQKGAPWGLGSISHKGQASTDYIYDTSAGAGTYAYVVDSGINVNHVEFESRASLAYNAAGGSHVDSIGHGTHVAGTIGGKTYGVAKKTNLLSVKVFQGESSSTSIILDGFNWAVNDIVSKGRTKKAAINMSLGGGYSYAFNNAVENAFDEGVLSVVAAGNENSDASNTSPASAPNALTVAAINKSNARASFSNYGSVVDIFAPGQDILSAWIGSTTATNTISGTSMATPHIVGLSVYLMGLENLSGPAAVTARIKELATNGVVTNVKGSPNKLAYNGNA

SEQ ID NO: 1232 - protein, 152 aa, Aspergillus fumigatus (Common mold)
MKFTTPISLISLFVSSALAAPTPENEARDAIPVSVSYDPRYDNAGTSMNDVSCSNGVNGLVTKWPTFGSVPGFARIGGAPTIPGWNSPNCGKCYKLQYEQNTIYVTAIDAAPGGFNIATSAMDQLTNGMAVELGRVQATYEEADPSHCASGV

SEQ ID NO: 1233 - protein, 395 aa, Aspergillus fumigatus (Common mold); identical to SEQ ID NO: 1227

SEQ ID NO: 1234 - protein, 197 aa, Aspergillus fumigatus (Common mold)
PTLVSREAPAVGVISDISAQTSALASAVSSYNGGDPSAVKSASEKLVSTINSGVDTVKSGPALSTADALALTSPVQDLTKQVEGVIDDLISKKDKFVAANAGGTVYEDLKAQYTAADSLAKAISAKVPESLSDIAAQLSAGITAAIQKGIDAYKDAASSTGTASSSAPATETATATETSTATGTVTETATSTPVIPT

SEQ ID NO: 1235 - protein, 495 aa, Aspergillus fumigatus (Common mold)
MKGYLSLSILPLLVAASPVVVDSIHNGAAPILSSMNAKEVPDSYIVVFKKHVNAESAAAHHSWVQDIHSAQNERVELRKRSLFGFGEEAYLGLKNTFDIAGSLVGYSGHFHEDVIEQVRKHPDVEYIEKDSEVHTMEDPTVEKSAPWGLARISHRDSLSFGTFNKYLYASEGGEGVDAYTIDTGINVDHVDFEGRAQWGKTIPTDDEDADGNGHGTHCSGTIAGRKYGVAKKANLYAVKVLRSSGSGTMSDVVAGVEWAVKSHLKKVKDAKDGKIKGFKGSVANMSLGGGKSRTLEAAVNAGVEAGLHFAVAAGNDNADACNYSPAAAENPITVGASTLQDERAYFSNYGKCTDIFAPGLNILSTWIGSKHAVNTISGTSMASPHIAGLLAYFVSLQPSKDSAFAVDELTPKKLKKDIIAIATQGALTDIPSDTPNLLAWNGGGSSNYTDIIASGGYKVNASVKDRFEGLVHKAEKLLTEELGAIYSEIHDAAVA

SEQ ID NO: 1236 - protein, 438 aa, Aspergillus fumigatus (Common mold)
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 1237 - protein, 392 aa, Aspergillus fumigatus (Common mold)
MSHRKYEAPRHGSLAFLPRKRAARHRGKVKSFPKYDPKKPVHLTASMGYKAGMTTVVRDLDRPGAKMHKKEIVEAVTIIETPPLVAVGVVGYIETPRGLRSLTTVWAEHLSDEVKRRFYKNWYKSKKKAFTKYAKKHAEENGASITRELERIKKYCTVVRVLAHTQIRKTPLKQKKAHLMEIQVNGGSVADKVDFARNLFEKPIEIDSIFEKDEMIDVIAVTKGHGFQGVTSRWGTKKLPRKTHKGLRKVACIGAWHPSHVQWTVARAGQMGYHHRTSCNHKVFRIGKGSDEGNASTDFDISKKQITPMGGFVRYGEVKNDYIMVKGSVPGVKKRVMTLRKTLYPQTSRRATEKVELKWIDTSSKFGHGAFQTPEEKRAFMGTLKKDLVTSA

SEQ ID NO: 1238 - protein, 163 aa, Aspergillus fumigatus (Common mold)
MVVKTFFDITIDGQPAGRITFKLFDEVVPKTVENFRALCTGEKGFGYKGSSFHRIIPQFMLQGGDFTKGNGTGGKSIYGDRFPDENFQLKHDKPGLLSMANAGKNTNGSQFFITTVVTSWLDGAHVVFGEVEDGMDLVKKIESYGSASGTPKKKITIADCGQL

SEQ ID NO: 1239 - protein, 108 aa, Aspergillus fumigatus (Common mold)
MSHGKVIAVDNPIIYKALTSSGPVVVDFFATWCGPCRAVAPKVGELSEKYSNVRFIQVDVDKVRSVAHEMNIRAMPTFVLYKDGQPLEKRVVGGNVRELEEMIKSISA

SEQ ID NO: 1240 - protein, 110 aa, Aspergillus fumigatus (Common mold)
MSHNVEKITDAKVFKEKVQEGSGPVIVDCSATWCGPCKAISPVFQRLSTSEEFKNAKFYEIDVDELSEVAAELGVRAMPTFMFFKDGQKVNEVVGANPPALEAAIKAHVA

SEQ ID NO: 1241 - protein, 185 aa, Aspergillus fumigatus (Common mold)
MQIKSFVLAASAAATASAAACQAPTNKYFGIVAIHSGSAVQYQPFSAAKSSIFAGLNSQNASCDRPDEKSATFYIQDGSLYLYAASATPQEIFVDRSGMGQGKIGYTTGAQPAPRNSERQGWAIDSQNHLQFQGKDLIACPNSIDGAWSIWADAGVANPAGNTDCVGIAARVEDVTNPNSCVYTQ

SEQ ID NO: 1242 - protein, 804 aa, Aspergillus niger (Black mold)
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESIAAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTNVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSQTHEDLASITQLPVLNFTANIRNTGKLESDYTAMVFANTSDAGPAPYPKKWLVGWDRLGEVKVGETRELRVPVEVGSFARVNEDGDWVVFPGTFELALNLERKVRVKVVLEGEEEVVLKWPGKE

SEQ ID NO: 1243 - protein, 479 aa, Aspergillus niger (Black mold) [sequence omitted]

SEQ ID NO: 1244 - protein, 403 aa, Aspergillus oryzae (Rice mold)
MQSIKRTLLLLGAILPAVLGAPVQETRRAAEKLPGKYIVTFKPGIDEAKIQEHTTWATNIHQRSLERRGATGGDLPVGIERNYKINKFAAYAGSFDDATIEEIRKNEDVAYVEEDQIYYLDGLTTQKSAPWGLGSISHKGQQSTDYIYDTSAGEGTYAYVVDSGVNVDHEEFEGRASKAYNAAGGQHVDSIGHGTHVSGTIAGKTYGIAKKASILSVKVFQGESSSTSVILDGFNWAANDIVSKKRTSKAAINMSLGGGYSKAFNDAVENAFEQGVLSVVAAGNENSDAGQTSPASAPDAITVAAIQKSNNRASFSNFGKVVDVFAPGQDILSAWIGSSSATNTISGTSMATPHIVGLSLYLAALENLDGPAAVTKRIKELATKDVVKDVKGSPNLLAYNGNA

SEQ ID NO: 1245 - protein, 499 aa, Aspergillus oryzae (Rice mold)
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEYCWLGDNTVSLLDLDTTKDVVKNEWYDWVGSLVSNYSIDGLRIDTVKHVQKDFWPGYNKAAGVYCIGEVLDVDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 1246 - protein, 403 aa, Aspergillus versicolor
MYSIKRTILLLGALLPAVFGAPILEARRQTEKVPGKYIVTFKSGLQAEQIDAHTTWASNVHKRNLERRDLTDRDLYPGIEKNFKIHKFAAYVGSFDDATIEEIRNHKDVAHVEEDQVWYLDALTTQSDAPWGLGAISHQGDASSDYIYDTSAGADTYAYVVDTGINVDHSEFDGRASLAYNAAGGQHVDSVGHGTHVAGTIGGKTFGVSKKANLLSVKVFEGESSSTSIILDGYNWAANDIVSKSRTGKSAINLSLGGGYSYAFSNAVESAFDEGVLSVVAAGNENVDASNTSPASAPNALTVAASTERNARASFSNYGEVVDIFAPGEDILSAWIGGNSATNTISGTSMATPHIVGLSLYLIALEGLSSPGDVTSRIKELATQGALSGVSGSPNALAYNGAE

SEQ ID NO: 1247 - protein, 350 aa, Candida albicans (Common yeast)
MSEQIPKTQKAVVFDTNGGQLVYKDYPVPTPKPNELLIHVKYSGVCHTDLHARKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 1248 - protein, 236 aa, Candida albicans (Common yeast)
MVKVLLALTSYNETFYSDGKKTGVFVVEALHPFEVFRKKGYEIQLASETGTFGWDDHSVVPDFLNGEDKEIFDNVNSEFNVALKNLKKASDLDPNDYDIFFGSAGHGTLFDYPHAKDLQKIATTVYNKGGVVSAVCHGPAIFENLNDPKTGEPLIKGKKITGFTDIGEDILGVTDIMKKGNLLTIKQVAEKEGATYIEPEGPWDNFTVTDGRIVTGVNPQSAVKTAEDVIAAFECN

SEQ ID NO: 1249 - protein, 167 aa, Candida boidinii (Yeast)
MAPIKRGDRFPTTDDVYYIPPEGGEPGPLELSKFVKTKKFVVVSVPGAFTPPCTEQHLPGYIKNLPRILSKGVDFVLVISQNDPFVLKGWKKELGAADAKKLVFVSDPNLKLTKKLGSTIDLSAIGLGTRSGRLALIVNRSGIVEYAAIENGGEVDVSTAQKIIAKL

SEQ ID NO: 1250 - protein, 388 aa, Cladosporium cladosporioides
DQEVHVLKSESEVEKNAPWGLARISHRDSLSFGTFNKYLYTEDGGEGVDVYVVDTGTNVDHVDFEGRASWGKTIPQGDADEDGNGHGTHCSGTVAGKKYGVAKKAHVKAVKVLRSNGSGSMSDVVKGVEYAAESHLEQVSIAKKGKRKGFKGSTANMSLGGGKSPILDKAVNAAVDAGIHFAVAAGNDNADSCNYSPAAAENAVTVGASTLSDERAYFSNYGKCNDIFAPGLNIQSTWIGSKYAVNTISGTSMASPHVAGLLAYLLSLQPAKDSAFAVADISPKKLKANLISIATVGALTDVPSNTANILAWNGGGESNYSAIVEKGGYKAAVRPTMLEEIESEAKVASKKVYSEGDELAKKVAELTEKIEDLISGDLKDMFRDLKRE

SEQ ID NO: 1251 - protein, 325 aa, Cladosporium cladosporioides
MSSSLDQLKASGTTVVCDSGDFATIGKYKPQDATTNPSLILAASKKPEYAKLIDDAVAYGMKHGKTTEEKIDATFDNLLVQFGSEILKIVPGKVSTEVDARFSFDKDVSIQKALRIIDLYKEAGIDKERVLIKLASTWEGIQAAHELQTKHGINCNLTLMFSLPQAIAAAEAGAYLISPFVGRILDWYKANTKQEYNASNDPGVKSVVDIFNYYKKYDYKTIVMGASFRNIGEITELAGCDYLTIAPALLEQLYNSTDAVPQKLKAEDVAKLDIEKKSYLKDEALFRFDFNEDPMAVNKLSEGISKFAADAVTLKDILREKIEKA

SEQ ID NO: 1252 - protein, 111 aa, Cladosporium herbarum (Fungus of plants)
MKYLAAFLLLGLAGNSSPSAEDIKTVLSSVGIDADEERLSSLLKELEGKDINELISSGSEKLASVPSGGAGAASAGGAAAAGGAAEAAPEAERAEEEKEESDDDMGFGLFD

SEQ ID NO: 1253 - protein, 440 aa, Cladosporium herbarum (Fungus of plants)
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 1254 - protein, 204 aa, Cladosporium herbarum (Fungus of plants)
MAPKIAIIFYSTWGHVQTLAEAEAKGIREAGGSVDLYRVPETLTQEVLTKMHAPPKDDSIPEITDPFILEQYDRFPHGHPTRYGNFPAQWRTFWDRTGGQWQTGAFWGKYAGLFISTGTQGGGQESTALAAMSTLSHHGIIYVPLGYKTTFHLLGDNSEVRGAAVWGAGTFSGGDGSRQPSQKELELTAQGKAFYEAVAKVNFQ

SEQ ID NO: 1255 - protein, 267 aa, Cladosporium herbarum (Fungus of plants)
MPGQQATKHESLLDQLSLKGKVVVVTGASGPKGMGIEAARGCAEMGAAVAITYASRAQGAEENVKELEKTYGIKAKAYKCQVDSYESCEKLVKDVVADFGQIDAFIANAGATADSGILDGSVEAWNHVVQVDLNGTFHCAKAVGHHFKERGTGSLVITASMSGHIANFPQEQTSYNVAKAGCIHMARSLANEWRDFARVNSISPGYIDTGLSDFVPKETQQLWHSMIPMGRDGLAKELKGAYVYFASDASTYTTGADLLIDGGYTTR

SEQ ID NO: 1256 - protein, 518 aa, Cladosporium herbarum (Fungus of plants)
MRGALAGLSLATLATASPVLVNSIHNDAAPIISASNAKEIADNYMIKFKDHVTQNLAAEHHGWVQDLHEKTQVAKTELRKRSQSPMVDDIFNGLKHTYNIAGGLMGYAGHFDEDVIEQIRRHPDVELVERDQEVHVLGSESEVEKNAPWGLARISHRDSLSFGTFNKYLYTEDGGEGVDVYVVDTGTNVDHVDFEGRASWGKTIPQGDADEDGNGHGTHCSGTVAGKKYGVAKKAHVKAVKVLRSNGSGSMSDVVKGVEYAAESHLEQVSITKKGKRKGFKGSTANMSLGGGKSPILDKAVNAAVDAGIHFAVAAGNDNADSCNYSPAAAENAVTVGASTLADERAYFSNYGKCNDIFAPGLNIQSTWIGSKYAVNTISGTSMASPHVAGLLAYLLSLQPAKDSAFAVADISPKKLKANLISIATVGALTDVPSNTANILAWNGGGESNYSAIVEKGGYKATHRPTMLEEIESEAKVASKKVYSEGDELAHKVAELTEKVEDLIAGELKDMFRELKRE

SEQ ID NO: 1257 - protein, 496 aa, Cladosporium herbarum (Fungus of plants)
MTSVQLETPHSGKYEQPTGLFINNEFVKGQEGKTFDVINPSDESVITQVHEATEKDVDIAVAAARKAFEGSWRQETPENRGKLLNNLANLFEKNIDLLAAVESLDNGKAISMAKGDISMCVGCLRYYGGWADKITGKVIDTTPDTFNYVKKEPIGVCGQIIPWNFPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGKRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 1258 - protein, 110 aa, Cladosporium herbarum (Fungus of plants)
MSAAELASSYAALILADEGLEITADKLQALISAAKVPEIEPIWTSLFAKALEGKDVKDLLLNVGSGGGAAPAAGGAAAGGAAAVLDAPAEEKAEEEKEESDDDMGFGLFD

SEQ ID NO: 1259 - protein, 440 aa, Curvularia lunata (Synonym: Cochliobolus lunatus)
MAITKIHARSVYDSRGNPTVEVDIVTETGLHRAIVPSGASTGSHEACELRDGDKTKWGGKGVTKAVANVNDIIAPALIKEKLDVKDQSAVDAFLNKLDGTENKTKLGANAILGVSMAIAKAAAAEKGVPLYAHISDLAGTKKPYVFRFLSKNVLNGGSHAGGFLLFQEFMIAPAKTFAEALRIRQGAEVYQKLKALTKKTYGQSAGNYGDEGGVAPDIQTAEEALDLIVDAIEAAGHTGQIKIAMDVASSEFFKDDEKKYDLDFKNPDSDKSKWLTYPQLAEMYKSLAEKYPIVSIEDPFAEDDWEAWSHFYKDGDFQIVGDDLTVTNPEFIKTAIELKSCNALLLKVNQIGTISEAINAAKDAFGAGWGVMVSHRSGETEDVTIADIVVGLRSGQIKTNAPARSERLAKYNQILRIEEELGDKRLFAGNKFHTAINLYL

SEQ ID NO: 1260 - protein, 108 aa, Curvularia lunata (Synonym: Cochliobolus lunatus)
MGFEQGDAKKGANLFKTRCAQCHTLKAGEGNKIGPELHGLFGRKTGSVAGYSYTDANKQKGIEWNHDTLFEYLENPKKYIPGTKMAFGGLKKPKDRNDLITFLEQETK

SEQ ID NO: 1261 - protein, 506 aa, Curvularia lunata (Synonym: Cochliobolus lunatus)
MKYSLIAALPALAAASPTFSTETIHKQSAPVLSSTSAKEVPNSYMVVFKKHVKDASKHHDWVQSVHSKNTQERMELRKRSSDLPVSNEVFAGLKHTYELSGLKGYSGHFDDETLEAIRNHPDVDYIERDSEVRILGGDEPETENNSPWGLARISHRDSLSFGTWNKYLYAADGGEGVDVYVIDTGTNVDHVDFEGRAKWGKTIPNGDADEDGNGHGTHCSGTVAGKKYGVAKKAHVYAVKVLRSNGSGTMSDVVKGVEFAAKSHSEAVSAAKNGKKKGFKGSTANMSLGGGKSTTLDMAVNAAVDAGLHFAVAAGNDNADSCNYSPAAAENAVTVGASTLLDERAYFSNYGKCNDIFAPGLNILSTWIGSKHATNTISGTSMASPHIAGLLAYMLSLQPAKDSAYAVADITPKKLKANLIAIGTVGALSDVPSNTANVLAWNGGGSSNYTDIIEKGGYTVKKAASKEEEKESEFRITIPSLSELEDDFEKAKESAGRKAHHVGGKL

SEQ ID NO: 1262 - protein, 18 aa, Epicoccum purpurascens (Soil fungus)
  misc_feature (17)..(17): Xaa can be any naturally occurring amino acid
ADGIVAVELDTYRGSFXK

SEQ ID NO: 1263 - protein, 109 aa, Fusarium culmorum (N.A.)
MKHLAAYLLLGLGGNTSPSAADVKAVLTSVGIDADEDRLNKLISELEGKDIQQLIAEGSEKLASVPSGGAGGASGGAAAAGGAAEEAKEEEKEEEKEESDEDMGFGLFD

SEQ ID NO: 1264 - protein, 121 aa, Fusarium culmorum (N.A.)
MVHHITSNDELQKLLSSTTYVVVDFFADWCPPCKAIAPVYEQLSTKHSVPDVLAFAKVNVDHVQDAAQQYGITAMPTFMFFKEGKQVAVNGQAVIKGADPRTLGAAAEKLGGLAQKRVAGA

SEQ ID NO: 1265 - protein, 323 aa, Fusarium proliferatum
MSSSLEQLKATGTTVVSDSGDFVSIGKYKPQDATTNPSLILAASKKAEYAKLIDVAIDYAKQKGGSIDQQVDDALDRLLVEFGKEILKIIPGKVSTEVDARYSFDTEASVNKALHLIELYGEQGISKDRILIKIAATWEGIKAAEILQRDHGINTNLTLMFSLVQAIGAAEAGAYLISPFVGRILDWFKASTKKEYSKEEDPGVQSVKTIFNYYKKYGYNTIVMGASFRNTGEITELAGCDYLTISPNLLEDLLNSNEPVPKKLDASQAASLDIEKKSYINDEALFRFDFNEDQMAVEKLREGISKFAADAVTLKSILKEKLA

SEQ ID NO: 1266 - protein, 386 aa, Fusarium proliferatum
DKCDGETERQAPWGLARISHRNTLNFGTFNKYLYSSDGGEGVDAYIVDTGTNVDHVDFEGRAHWGKTIPSGDADEDGNGHGTHCSGTVAGKKYGVAKKANVYAVKVLRSNGSGSMSDVVKGVEFAATSHLEQKKKAKDGKRKGFKGSVANMSLGGGKTQALDAAVNAAVRTGIHFAVAAGNDNADACNYSPAAASEPVTVGASALDDSRAYFSNYGKCTDIFAPGLNIQSTWIGSKYAVNTISGTSMASPHIAGLLAYYLSLQPAEDSEYALASITPKKLKENLISVATEDALSDIPSDTPNLLAWNGGGCSDYKKIVEAGSYKVKAAPSSRVEEIKHAVEQEVNLVSGKLTTGAKELGSKAEKFSKKIHELVDEELEEFLKELNL

SEQ ID NO: 1267 - protein, 107 aa, Penicillium brevicompactum (Penicillin)
MSTAELAVSYAALILADDGIEVSADKIQTILGAAKVQEVEPIWATIFAKALEGKDIKEILTNVGSAGPATAGAPAAAGAAAPAEEKKEEKEEEKEESDEDMGFGLFD

SEQ ID NO: 1268 - protein, 397 aa, Penicillium chrysogenum (Penicillin)
MGFLKVLATSLATLAVVDAGTLLTASNTDAVIPSSYIVVMNDDVSTAEFSTHREWATNVHARLSRRKNGETGPGKHFEINGLKGYTASFDENTAKDIANDPAVKYIEPDMIVNATANVVQSNVPSWGLARISSKRTGTTSYTYDSTAGEGVVFYGVDTGIDISHSDFGGRAKWGTNVVDNDNTDGNGHGTHTASTAAGSKYGVAKKATLVAVKVLGADGSGTNSGVISGMDWAVKDAKSRGANGKYVMNTSLGGEFSKAVNDAAANVVKSGIFLSVAAGNEAENASNSSPASAAEACTIAASTSTDGSASFTNFGSVVDLYAPGQSITAAYPGGGSKTLSGTSMAAPHVAGVAAYLMALEGVSAGNACARIVQLATSSISRAPSGTTSKLLYNGINV

SEQ ID NO: 1269 - protein, 494 aa, Penicillium chrysogenum (Penicillin)
MKGFLSLTLLPLLVAASPVAVNSIHNDAAPILSSMTSKDIPDSYIVVFKKHVDPSSASAHQSWLQEVHTAHTGRMELKKRSLFGFDFEAFMGLKHTFHIAGSLLGYAGHFHEDVIEQIRRHPDVDYIEKDSEVRTMSEGSVEKNAPWGLARISHRESLSFGNFNKYLYAEEGGEGVDAYVIDTGANVKHVDFEGRANWGKTIPQGDADEDGNGHGTHCSGTIAGKKFGVAKKANVYAVKVLRSNGSGTMSDVVKGVEWAAEAHIKKSKKGDKKFKGSVANMSLGGGSSRTLDLAVNAAVDAGIHFAVAAGNDNADACNYSPAAAEKAITVGASTLADERAYFSNYGKCTDIFAPGLNILSTWVGSDHATNTISGTSMASPHIAGLLAYYVSLAPAKDSAYAVADVTPKQLKAALISVATEGTLTDIPSDTPNLLAWNGGGSANYTKILADGGYKAHNAETTVEDRIGIIIDSAEKAFHKELGAIYSEIKDAVSV

SEQ ID NO: 1270 - protein, 117 aa, Penicillium chrysogenum (Penicillin)
GPYKTWQRIYDYDFLTNLTSSEANDIIGAEAPLWSEQVDDVTVSSVFWPRAAALGELVWSGNRDAAGRKRTTSFTQRILNFREYLVANGVMAAALVPKYCLQHPHACDLYKNQTVMS

SEQ ID NO: 1271 - protein, 557 aa, Penicillium chrysogenum (Penicillin)
MRFNTALTSALVSSASLMGYAHAEETADTTVIDRPTFTPTSLKAPFLEQFTDDWESRWKPSHAKKDDKSDDEWAYVGEWAVEEPSVFKGIDGDKGLVVKNAAAHHAISAKFPKKIDNKGKTLVVQYEVKPQNSLVCGGAYLKLLQENKKLHQDEFSNGTPYVVMFGPDKCGATNKVHFIFCHKNPKTGEYEEKHLKTPPVARTDKVTSLYTLIVNPDQTFEILINGDSAKKGSLLEDFNPPVNPEKEIDDPKDSKPADWVDEVKIPDPEATKPADWDEEAPFEILDEEATQPADWLEDEPESIPDPEAEKPEDWDDEEDGDWLAPTIPNPKCADVSGCGTWTRPMIKNPEYKGKWEAPLIDNPAYKGVWAPRKIKNPAYFEDKTPSNLEPMGAIGFEIWTMQNDILFDNVYVGHSVEDAEKLRKETFDVKFPIEEAEEEASKPKPEVNEEGTTVTFQEDPVTFVRQKVNHFVELAKEDPVNAAKTLPEVAGGLGALLLTMILVVVGAIGASSPAAPAEKKGKQPAGAPKEKKEQAVSSSAETSKGGATKRTTRSSAE

SEQ ID NO: 1272 - protein, 151 aa, Penicillium chrysogenum (Penicillin)
MKTSLITFGALLGLVSAQNAVVNNHCDTSVYVQSFPFDGSAPGPLTTVPKGETFSEKFRTSGSTVKIAKTKTLDKPLFFGYSFSSNPDYAYYELSTEWGNPFAANPNSLSPGDGCEVFDCAANDAACYSTPAHKKVYGCPQPVTLTADLCQ

SEQ ID NO: 1273 - protein, 324 aa, Penicillium chrysogenum (Penicillin)
MSSSLEQLKASGTTVVCDSGDFATIGKYKPQDATTNPSLILAASKKPEYAALIDTAVAYGKQNGKTLDEQVEATLDRLLVEFGKEILKIIPGKVSTEVDAKLSFDTQGSVNKALEIIKLYADNGISKDRVLIKIASTYEGIKAAHILQTQHGINCNLTLMFSLVQAIAAAEAGAYLISPFVGRILDWYKAAHKRDYTPQEDPGVKSVQDIYNYYKKFGYNTIVMGASFRNVGEITELAGCDYLTISPNLLEDLFNSTDAVPQKLNPAGAASLEIKKREYLNNEADFRFDFNEEAMGVEKLREGISKFAADAVTLKQLLAQKIQA

SEQ ID NO: 1274 - protein, 167 aa, lium citrinum (Penicillin)
MSLKAGDSFPEGVTFSYIPWAEDASEITSCGIPINYNASKEFANKKVVLFALPGAFTPVCSANHVPEYIQKLPELRAKGVDQVAVLAYNDAYVMSAWGKANGVTGDDILFLSDPEAKFSKSIGWADEEGRTYRYVLVIDNGKIIYAAKEAAKNSLELSRADHVLKQL

SEQ ID NO: 1275 - protein, 64 aa, lium citrinum (Penicillin)
  misc_feature (63)..(63): Xaa can be any naturally occurring amino acid
ANVVQSNVPSWGLARISSKRTGTTSYTYDSTAGEGVVFYGVDTGSAAEVSTIAASTSTDGSAXF

SEQ ID NO: 1276 - protein, 503 aa, lium citrinum (Penicillin)
AYLGGTVNNAVITVPAYFNDSQRQATKDAGLIAGLNVLRIINEPTAAAIAYGLDKKTEGERNVLIFDLGGGTFDVSLLTIEEGIFEVKSTAGDTHLGGEDFDNRLVNHFVNEFKRKHKKDLTTNARALRRLRTACERAKRTLSSAAQTSIEIDSLFEGIDFYTSITRARFEELCQDLFRGTMEPVERVLRDAKIDKSSVHEIVLVGGSTRIPKIQKLVSDFFNKDANKSINPDEAVAYGAAVQAAILSGDTSSKSTNEILLLDVAPLSLGIETAGGVMTPLIKRNTTIPTKKSETFSTYSDNQPGVLIQVFEGERARTKDNNLLGKFELTGIPPAPRGVPQIEVTFDLDANGIMNVSASEKGTGKSNKITITNDKGRLSKEEIERMLAEAEKYKAEDEAEASRIQAKNGLESYAYSLKNTITEGKLQMSDDDKKKIEDKISEIISWLDNNQTAEKDEYESQQKELEAIANPIMQAAYGAAGGAPPQQRADGETEEKKDEEELD

SEQ ID NO: 1277 - protein, 438 aa, lium citrinum (Penicillin)
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 1278 - protein, 228 aa, lium citrinum (Penicillin)
MGFTDFVSDAGLSLANNYLATRSYIVGHAPSQADVVTYKAFTASPDAEKYPHVARWYKHIASYESEFPTLPGDASKAFTAYGPEGSEASANPKDKPAEEEEEEDLFASDSEDEDPAVVAERNKNLEEYKKKKAAKGPKPAAKSLVTLEVKPWDDETNLEELEANVRAIEMDGLVWGASKFVAVGFGIKKLQINLVVEDEKVSTDELQAQIEEDEDHVQSTDVAAMQKL

SEQ ID NO: 1279 - protein, 733 aa, lium citrinum (Penicillin)
MHLLAFATDLVGIANAACPYMTGEVPGDYSPHELHRRADEGAADNTEEFLSQFYLNDKDAYLTSDVGGPIEDQNSLSAGERGPTLLEDFIFRQKIQHFDHERVPERAVHARGAGAHGVFTSYADWSNITAASFLSKKDKETPMFVRFSTVAGSRGSADTARDVHGFATRFYTDEGNFDIVGNNIPVFFIQDAIQFPDLIHAVKPSGDNEIPQAATAHDSAWDFFSQQPSSLHTLLWAMAGHGIPRSFRNVDGFGVHTFRFVTDSGKSKLVKFHWKGLQGKASLVWEEAQQISGKNPDFLRQDLWDAIEAGRFPEWELGVQIMDEEDQLRFGFDLLDPTKIVPEEIIPVTKLGKMTLNRNPRNYFAETEQVMFQPGHIVRGVDFTDDPLLQGRLFSYLDTQLNRHGGPNFEQLPINRPRTPIHNNNRDGAGQMFIPLNKDAYSPNTLNNASPKQANQTTGKGFFTTPSRKGNGKLQRTVSSTFEDVWSQPRLFWNSLVEAEKQFVVDATRFENSNVVSDIVRNNVIIQLNRISNDLAKRVAEAIGIEAPKPDPSFYHDNTTAHIGAFGQKLLKLEGLKVGVLASVQNASSVSSAASLQSQLKDAGVDVVVVAERLGDGVNQTYSGSDAIQFDAVVVADGAEGLFSSRSFTEKPVKNKASSLFPAGRPLDILVDAFRFGKPVGAIGKGAAALRAAQISSDREGVYAAKSIGNEFVKGLKEGLRIFKFLDRFALDA

SEQ ID NO: 1280 - protein, 290 aa, lium citrinum (Penicillin)
VGDVATGYASENGGTTGGSGGTTTTVSSYAAFTEAVSGDDAKVVFVSGKISKTADQARVGSNTSIIGKDSNAILSGFGVLVKEASNVIIRNLGVEKVLADNGDAIGIQKSNNVWVDHCDVSSDRDHDKDYYDGLIDITHAADYVTVSNTSIHDHWKACLIGHSDSNGDEDKGHLHVTLNNNYWYNINSRGPSFRFGTGHVYNSYYLDMSDGINTRQGAQHLVESNTFSGSKKPLYSTDDGYAVANDNDFGDGENNAEKGTLTSVPYSYDLVGSGKVKDAVVGTAGQTLTF

SEQ ID NO: 1281 - protein, 107 aa, Penicillium crustosum
MSTAELACSYAALILADDGIEISADKIQTLISAANVQEVEPIWASIFARALEGKDIKELLTNVGSAGPASAAPAGAAGAAAPAEEKAEEKEEEKEESDEDMGFGLFD

SEQ ID NO: 1282 - protein, 503 aa, Penicillium oxalicum (Penicillin )
MKGLLSLTLLPLLAAASPTWSETIHNGAAPLISSTSAKEIPDSYIVVFKKHVGASAASAHHSWVQDIHSDNVRMELKKRSLFGFESEPYLGVKHTFHVAGSLMGYAGHFHEDVIEQVRRHPDVEYIEKDSEVHHFEDPAIEKNAPWGLARISHRDSLSFGSFNKYLYAEDGGEGVDAYVIDTGTNVDHVDFEGRASWGKTIPQGDQDVDGNGHGTHCSGTIAGKKYGVAKKANVYAVKVLRSNGSGTMSDVVKGVEWAAEAHIKKSKAAKDGKAKGFKGSVANMSLGGGSSRTLDLAVNAAVDAGMHFAVAAGNDNADACNYSPAAAEKAVTVGASTLADERAYFSNYGKCTDIFAPGLNILSTWIGSKYAVNTISGTSMASPHIAGLLAYYVSLQPASDSAYAVEEITPKKLKDALITIATSGALSDIPSDTPNLLAWNGGGSSNYTEIVSKGGYKAGASESMKKHLDELVGKVEEVIAKEQKVLSHELGAIYSEIKDAVSA

SEQ ID NO: 1283 - protein, 144 aa, Stachybotrys chartarum
ASVTFWTLDNVDRTLVFTGNPGSAAIETITVGPAENTTVEFPGSWVGNWYAYPTDAEDVPGMLGEVQFGGWNGLTYFDVSAIVNPTDHDNVKQMWPAESRKPMSGCEVFPCDNAYWLPDDIQTKVTHEVDLWTTLGAGSTGLTF

SEQ ID NO: 1284 - protein, 412 aa, Trichophyton rubrum
MGFITKAIPIVLAALSTVNGARILEAGPHAEAIPNKYIVVMKREVSDEAFNAHTTWLSQSLNSRIMRRAGSSKPMAGMQDKYSLGGIFRAYSGEFDDAMIKDISSHDDVDFIEPDFVVRTTTNGTNLTHQDNVPSWGLARVGSKKPGGTTYYYDPSAGKGVTAYIIDTGIDIDHEDFQGRAKWGENFVDQQNTDCNGHGTHVAGTVGGTKYGLAKGVSLVAVKVLDCDGSGSNSGVIKGMEWAMRQASGGGNGTAKAAGKSVMNMSLGGPRSEASNQAAKAISDAGIFMAVAAGNENMDAQHSSPASEPSVCTVAASTKDDGKADFSNYGAVVDVYAPGKDITSLKPGGSTDTLSGTSMASPHVCGLGAYLIGLGKQGGPGLCDTIKKMANDVIQSPGEGTTGKLIYNGSGK

SEQ ID NO: 1285 - protein, 726 aa, Trichophyton rubrum
MAAAKWLIASLAFASSGLAFTPEDFISAPRRGEAIPDPKGELAVFHVSKYNFDKKDRPSGWNLLNLKNGDINVLTTDSDVSEITWLGDGTKVVYINGTDSVKGGVGIWISDAKNFGNAYKAGSVNGAFSGLKLAKSGDKINFVGYGQSTTKGDLYNEAAAKEAVSSARIYDSLFVRHWDTYVGTQFNAVFSGTLTKSGDKYSFDGKLKNLVQPVKYAESPYPPFGGSGDYDLSSDGKTVAFMSKAPELPKANLTTSYIFLVPHDGSRVAEPINKRNGPRTPQGIEGASSSPVFSPDGKRIAYLQMAAKNYESDRRVIHIAEVGTNKPVQRIASNWDRSPEAVKWSSDGRTLYVTAEDHATGKLFTLPADARDNHKPAVVKHDGSVSSFYFIGSSKSVLISGNSLWSNALYQVATPDRPNRKLFYANEHDPELKGLGPNDIEPLWVDGARTKIHSWIVKPTGFDKNKVYPLAFLIHGGPQGSWGDNWSTRWNPRVWADQGYVVVAPNPTGSTGFGQKLTDDITNDWGGAPYKDLVKIWEHVHDHIKYIDTDNGIAAGASFGGFMVNWIQGQDLGRKFKALVSHDGTFVGSSKIGTDELFFIEHDFNGTFFEARQNYDRWDCSKPELVAKWSTPQLVVHNDFDFRLSVAEGVGLFNVLQEKGVPSRFLNFPDETHWVTKPENSLVWHQQVLGWVNKWSGINKSNPKSIKLSDCPIEVVDHEAHSYFDY

SEQ ID NO: 1286 - protein, 26 aa, Trichophyton tonsurans
FTPEDFISAPRRGEAIPDPKGELAVF

SEQ ID NO: 1287 - protein, 81 aa, Coprinus comatus (Shaggy mane)
RFLPSSSHLNPQHLPWLVHPAPVLLLPVLPQLKPVAHPLLLLPLDTTTLHMPPLLLQLQLPPLLSQGNPACSPKWLQLLVP

SEQ ID NO: 1288 - protein, 106 aa, Coprinus comatus (Shaggy mane)
MVQVISNLDEFNKLTNSGKIIIIDFWATWCGPCRVISPIFEKFSEKYGANNIVFAKVDVDTASDISEEAKIRAMPTFQVYKDGQKIDELVGANPTALESLVQKSLA

SEQ ID NO: 1289 - protein, 328 aa, Coprinus comatus (Shaggy mane)
DSKRDESDSFKRRMESLHDPTSTNLYMEGLPLSIDEPTLAALVSPHRISSSRFFQTRLSHPPRIIAFVRLETRAGAEEIIERLHGRMVRGWNDTGSRISVRFADTAEQRELRRTERAAKEGDLTSSKLTIAQAALLNLRGQELRQATIGTLPVIGERRNLNVTDASYNELPSNALQLPLSQMSRPFEVDYTLAPGRAVPHITVPTSTNNPISQTYNRPLPRNVEPTLPLAMDQMRSNSTTFRNAQAAYDSYLHQSVTLPNQQYASEDYSVRPGPANAHTGYTATEEFIMRAHVDARRRHGPLDVTAPVRSRRDCDPEATAANISTGVR

SEQ ID NO: 1290 - protein, 141 aa, Coprinus comatus (Shaggy mane)
MYVAGVSFQQDTMPVLVHRKLEVNHKPPAVKEIVKHLIQVLNPKLHLYLFPVRRNPGYLKFTISLHLFLAHINCIHYSTSKLPSSSTLSSAKRSSISRNSSSSSLSDITMNSSESLPITLSLLSSNIACFLAFSFAFCLAV

SEQ ID NO: 1291 - protein, 152 aa, Coprinus comatus (Shaggy mane)
DPLVLSFFIPSLVLITILRSFTTLIYRYHAYIHPQCDSCHSSPPLYLSWPQPCPSAATTGSLTTSKCSTLLLPSNSWRTLSINKAWPDSPIRTLSGLDFQTGLVDAFYRSNGTNGTICGSSTMPSNSPMPNSSDHAATSSQQMILLPLPGPV

SEQ ID NO: 1292 - protein, 177 aa, Malassezia furfur (Pityriasis versicolor skin infection)
MPGDPTATAKGNEIPDTLMGYIPWTPELDSGEVCGIPTTFKTRDEWKGKKVVIVSIPGAYTPICHQQHIPPLVKRVDELKAKGVDAVYVIASNDPFVMAAWGNFNNAKDKVVFATDIDLAFSKALGATIDLSAKHFGERTARYALIIDDNKIVDFASDEGDTGKLQNASIDTILTKV

SEQ ID NO: 1293 - protein, 166 aa, Malassezia furfur (Pityriasis versicolor skin infection)
EIGSTIPNATFAYVPYSPELEDHKVCGMPTSFQSHERWKGKKVVIVAVPGAFTPTCTANHVPPYVEKIQELKSKGVDEVVVISANDPFVLSAWGITEHAKDNLTFAQDVNCEFSKHFNATLDLSSKGMGLRTARYALIANDLKVEYFGIDEGEPKQSSAATVLSKL

SEQ ID NO: 1294 - protein, 342 aa, Malassezia furfur (Pityriasis versicolor skin infection)
MFARAALRNSVRAPASARYFSQTAAANRKVAVLGASGGIGQPLSLLMKLNPKVTELRLYDIRLAPGVAADLSHINTPAVTSGYAQDDLEGAVDGAEIVLIPAGMPRKPGMTRDDLFNSNASIVRDLAKVVAKVAPKAYIGVISNPVNSTVPIVAEVFKKAGVYDPKRLFGVTTLDTTRAATFLSGIAGSDPQTTNVPVIGGHSGVTIVPLISQAAQGDKVQAGEQYDKLVHRIQFGGDEVVKAKDGAGSATLSMAYAAAVFTEGLLKGLDGEAVTQCTFVESPLFKDQVDFFASPVEFGPEGVKNIPALPKLTAEEQKLLDACLPDLAKNIKKGVAWAAENP

SEQ ID NO: 1295 - protein, 350 aa, Malassezia sympodialis (Skin fungus)
MRYSTVLAALALLGTSAVSVLAALPDQIDVKVKNLTPEDTIYDRTRQVFYQSNLYKGRIEVYNPKTQSHFNVVIDGASSNGDGEQQMSGLSLLTHDNSKRLFAVMKNAKSFNFADQSSHGASSFHSFNLPLSENSKPVWSVNFEKVQDEFEKKAGKRPFGVVQSAQDRDGNSYVAFALGMPAIARVSADGKTVSTFAWESGNGGQRPGYSGITFDPHSNKLIAFGGPRALTAFDVSKPYAWPEPVKINGDFGTLSGTEKIVTVPVGNESVLVGARAPYAISFRSWDNWKSANIKKTKRSELQNSGFTAVADYYQGSEQGLYAVSAFFDNGAHGGRSDYPLYKLDNSILNF

SEQ ID NO: 1296 - protein, 172 aa, Malassezia sympodialis (Skin fungus)
MSATTGSQAPNTTFTYIPWAPELDSGKVCGVPQTFKAHDRWKGKKVVVVAIPGAFTPACHQNHIPGFVEKINELKAKGVDEVVVIAVNDAFVMSGWGVTVGGKDQIVYACDNDLAFSKALGGTLDLTSGGMGVRTARYAVVLDDLKITYFGMDEGNMGAPEKSSVDAVLAQL

SEQ ID NO: 1297 - protein, 162 aa, Malassezia sympodialis (Skin fungus)
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVIDGMNVVKAIEAEGSGSGKPRSRIEIAKCGVC

SEQ ID NO: 1298 - protein, 187 aa, Malassezia sympodialis (Skin fungus)
AVSASPTPSKHNLYCYAQGKDLFEFHINDTVTKDVCKSLNSGKYHNMNNEKYCSVADYDVKWFKERCQSHPTDVKTTKWIAGTDLKIEMDPKEPYELYCFNYYTTFGNLPDAGAKELDDDATKKACSALKSGKYQSDPKKKSCRMDKKDIDQFKEQCSQYQPSDRPPYGDWSAGTSLNVVLNLKKNA

SEQ ID NO: 1299 - protein, 179 aa, Malassezia sympodialis (Skin fungus)
MVALKFAAVLSVVAAAVMAAPSSMDRRASPDNQVWVTSASDYCLILPRHRESIGDSESPGRMRSFCSKPYDSSQGQINPGFWKEVHFKKTKNYVQLTGCINPRVQSTLLSHDDGGQYDSNGNGGVGNPEGSVCLGYSSYVELVEPSDGKACIRCCVNDKYCDVGHDEDGCEAVIPGQYC

SEQ ID NO: 1300 - protein, 342 aa, Malassezia sympodialis (Skin fungus)
MSNVIKKVFNTDKAEAEGSKVADAPQEAGHKGEGFLHDAKDRLQGFAGHGHHNAQNAASGVAGSAGAGGAPSVPSANVDVTNPVNDASVQGGVEAPRSWSTQLPQSQSVADTTGATSAGRNNLTQTTSTGSGVNVAAGNVDQDVQHLAPVTRHVHHRHEIEELLREREHHIHQHHIQHHVQPVVDSEHLAEQIHSRVVPQTTVREVHANTDKDAALMRAVAGNPKDTFTQAAIDRSVIDKGETVREIVHHHIHNIVQPIIEKETHEYHRIRTTIPTTHITHEAPIVHESTAHQPIRKEDFLKGGGVLTSTTRSIEEVGLLNLGNNQRTVEGETYTGGLPLSQ

SEQ ID NO: 1301 - protein, 773 aa, Malassezia sympodialis (Skin fungus)
MSSVVGLDIGNSSSKIGVARARGVDIVSNEVSNRSTPSLVSFGQKARLLGEGAATAQTSNFKNTVGSLKRLIGRTFQDESIQTYEKPFVNAELVDAKGEVGVKVRFQNEEHIFSATQLLAMYLGKLLDTTQNELGGSGVSDVVLSVPIWFTDAQRRAMLHAAEIANLNPLRVMNEPTATALGYGITKTDLPEPDSPRNVIFVDIGHSSYQVSVVAFCKGQLTVLGAWADPNFGGRNFDRVLMEHFAEEFKGKYKIDVFFNPKATFRLAAGCERLKKVLSANTLAQLNVESLMNDIDAASQLKRDEFESLIAPYLERVNGPLDAALSQSGLTKDEIHSVELVGGSSRVPALKERIAAWYGKPLSYTLNQDEAIVRGCTLACATLSPVFRVREFSVHDISSYPIKVSWEPAPDVPDEENELVVFNTNNPVPSTKILTFYRKEPFSLDATYADASTLPKGTNPWLGRVTIKNVAPNEKGEHSIVKVKARLNLHGVLNVESAYTVDEIEKEEEVPVVDPNAAEDAEPKTEKKIVKKLQRKDDLPIVSGIGLLDPTLLAELKEREGQMYAADKLVADTEDRKNALEEYIYDTRSKLDERYATFVQSEEKEKLLAMLAESEDWLYTEEGEDATKSAYVSRLETLQKVGAPIHFRWKEHEERPKAAAQLREVVNKYMSVFENEPEKYDHLSDDDKTKVIEKAATVGKWLDDYMYKQSELPKNVDPKLTSEEILKKKDDVIYVCTPILTKPKPRVPVDTSKPEENAQTSNENEKQGDMDVD

SEQ ID NO: 1302 - protein, 237 aa, Malassezia sympodialis (Skin fungus)
PFYPIPSALPFPLPIHSLFSRRTRLFRFSRTAARAGTEHTLPPLPYEYNALEPFISADIMMVHHGKHHQTYVNNLNASTKAYNDAVQAQDVLKQMELLTAVKFNGGGHVNHALFWKTMAPQSQGGGQLNDGPLKQAIDKEFGDFEKFKAAFTAKALGIQGSGWCWLGLSKTGSLDLVVAKDQDTLTTHHPIIGWDGWEHAWYLQYKNDKASYLKQWWNVVNWSEAESRYSEGLKASL

SEQ ID NO: 1303 - protein, 618 aa, Malassezia sympodialis (Skin fungus)
MKGIVSWAVVSAALVLSATESLAFANVSSFEKRTTTGNGWDLDGKSYDYVIVGGGTAGLVLANRLSANQGTTVAVIEAGNSGYDDNDKFVVPDANLYNSAVNTQYDWQFHTSSQKHMNNRRASWPRGKVLGGSSAVNGLYYVRPSETEVNVWSKLAGGSGRWSWNSLLSGMKKSEHFRGPVKSVQNQLQIQYNAGSHGSNGPIGTTWPAVTYDPVERFIKTADSMSGAINNDPYNGNNHGTYVALSSIDKTNWQRSFSRNGYLDPISKRSNLHVLTGHTVTGIIFDRSGKNAQATGVHYAASSNEASHTVHANKEVIISGGAINSPQILQLSGIGDKNLLNGLGIDVVVDLPGVGENLQDHVSAGMSFKPKNKKDAGPTSVTGDAKADSYVNSAVSYTSLGKLFNNKDSILGKIQARAKQIADSHNVSPAVKQGQSKAYNALADTIFPSKVSPVEILGNVMFGSISIQAALQHPLSRGSIKITSKDPFAYPKINPNYFAENLDLVLLREGFKLIREMSQQSPLKDVIDFETVPGDKVQTNEDWENWIRSAAGTEYHPSSTCAMLPRGDGGVVDENLKVYGTSNLRVVDASVTPIAMSCHLESVVYGLAEVAADIILGN

SEQ ID NO: 1304 - protein, 105 aa, Malassezia sympodialis (Skin fungus)
VQVISSYDQFKQVTGGDKVVVIDFWATWCGPCKMIGPVFEKISDTPAGDKVGFYKVDVDEQSQIAQEVGIRAMPTFVFFKNGQKIDTVVGADPSKLQAAITQHSA

SEQ ID NO: 1305 - protein, 439 aa, Rhodotorula mucilaginosa (Yeast)
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 1306 - protein, 342 aa, Rhodotorula mucilaginosa (Yeast)
TMELLEDLIEQVRQLPMVNFIEKNSLVHANEFTVAKGAPWGLARISHRDPLSLGSFDQYLYDSNGGTGVTSYVIDTGVNVHHEQFEGRAKWGKTIPQGDEDEDGNGHGTHCAGTIGSNAYGVAKNAEIVAVKVLRSNGSGSMSDVIKGVEFAVKSHQDSVKKGKNSFSTANMSLGGGKSPALDLAVNAAVKAGLHFAVAAGNENQDACNTSPASAENAITVGASTISDARAYFSNYGKCVDIFAPGLNILSTYIGSDAATAYLSGTSMASPHIAGLLTYYLSLQPSSDSEFFIGAEGITPAQLKKNLIAFGTPDVLADIPADTPNILAFNGAGQNLTKFWGH

SEQ ID NO: 1307 - protein, 576 aa, Schizophyllum commune
MGLASTVSLALLGLCSLARAQTSAADAYVSAESPIAQAGILANIGPSGSKSHGAASGVIIASPSTSNPDYLYTWTRDAALVSRALVDEFIEGESSLQSVIDSYVSSQQKLQRVDNPSGSYTSGGLGEPKFNIDLTAFTGAWGRPQRDGPALRAITLITYGNHLLSSGNTSYVTDTIWPVVKADLDYVVSYWNQTGFDLWEEVSSSSFFTTAEQHTALRLGATFATAVGASASTYLTQADNVLCFLQSYWNSNGGYATANTGGGRSGIDANTVLTSIHTFDIEAGCDSVTFQPCSDRALSNLKVYVDSFRGLYSINPTGATDPILTGRYKEDVYYNGNPWYLTTFAVAEQLYDALNTWDKLGSLDVTSTSLAFFKQFDSSITAGTYASSTSEYATLTSAIRNWADGFLEVLADFTPADGGLTEQIDKSSGNPTSAADLTWSYASAITAFKARGGAIPASWGAAGLTVPATCSTGGGGGSGGDTVAVTLNVQATTVYGENIYVTGSVNQLANWSPDNAIALNADNYPTWSVTVNLPANTQIEYKYIRKNNGQVTWESDPNRSITTSASGSFTQNDTWR

SEQ ID NO: 1308 - protein, 401 aa, Rhizopus oryzae (Bread mold)
MKFFALSLVVSAAFSVFTDAAITKIPIKKVHETATEKLSRYSHTGEYLTQKYFNSQRNNQPMETFKLNPDGSANHGVPLSNYLNAQYYGEIEIGTPPQPFTVVFDTGSSNLWVPSTHCTSIACFLHKRYDSASSRTYSENGTEFAIQYGTGSLEGFISQDTLSVGGIQVEDQGFAESTKEPGLTFAFAKFDGIFGLGYDTISVKHTIPPFYHMVNRDLVDEPLFSFWLNDANKDQDNGGELIFGGVDEDHFEGDIHWSDVRRKGYWEITMENIKFGDDYVDIDPVGAAIDTGSSLLVAPTTVAALINKELGAEKNWAGQYVVDCNKVPSLPEFCFVFNGKDFCLEGKDYVLEVQGQCISGFMGMDIPEPAGPLWIVGDVFLRKFYSVYDLGNNRVGLAPSK

SEQ ID NO: 1309 - protein, 164 aa, Rhizopus oryzae (Bread mold)
MSNPKVFFDVSANSKPLGRIVMELRADVVPQTAENFRALCTGEKGFGYKGCSFHRVIPEFMLQGGDFTNHNGTGGKSIYGNKFRDENFTLKHTGPGDLSMANAGPNTNGSQFFITTIKCSWLDGKHVVFGRVTEGMDVVQNIESLGSPNGTPRAKIIIDNCGQL

SEQ ID NO: 1310 - protein, 131 aa, Ananas comosus (Pineapple)
MSWQAYVDDHLMCEIDGQHLSSAAILGHDSTVWAQSPNFPQFKPEEISAILNDFENPGSLAPTGLYLGGTKYMVIQGEPGVVIRGKKGTGGITVKKTNLALIIGVYDEPMTPGQCNMVVERLGDYLLEQGF

SEQ ID NO: 1311 - protein, 351 aa, Ananas comosus (Pineapple)
MASKVQLVFLFLFLCAMWASPSAASRDEPNDPMMKRFEEWMAEYGRVYKDDDEKMRRFQIFKNNVKHIETFNSRNENSYTLGINQFTDMTKSEFVAQYTGVSLPLNIEREPVVSFDDVNISAVPQSIDWRDYGAVNEVKNQNPCGSCWSFAAIATVEGIYKIKTGYLVSLSEQEVLDCAVSYGCKGGWVNKAYDFIISNNGVTTEENYPYLAYQGTCNANSFPNSAYITGYSYVRRNDERSMMYAVSNQPIAALIDASENFQYYNGGVFSGPCGTSLNHAITIIGYGQDSSGTKYWIVRNSWGSSWGEGGYVRMARGVSSSSGVCGIAMAPLFPTLQSGANAEVIKMVSET

SEQ ID NO: 1312 - protein, 32 aa, Anthoxanthum odoratum (Sweet vernal grass)
IAKVPPGPNITATYGDKWLDAKSTWYGKPTGA

SEQ ID NO: 1313 - protein, 490 aa, Cocos nucifera (Coconut)
MVSAMGDRTASAILALLLLSSWSLMVVMAYQGRGMEGREKRVEEKAPRSPEDRGLFILRRSKEVLKTDAGEVRLMMGYRYRGNHSPMHIGFITMEPNTLYIPQYIDASLILFVRRGEAKVGYIYKNKLVEKRLKSGYVDAIPAGSSFYIVNSDKSERLHIICSIDTLESMEYYGAYPQSFYVGGGVLPRSVLSGFDASTLSAAFNVSSDQLEMILNSQRGGPIIRLNGEAAEQRDYLSSIMQLKERMVQEKEMDSDDDDEAEQEEDDVWTWRCLLKSLLGKGDCRVQRKHKLAHSPGSYNLYDTEPSYQNDYGYSIAIDGHDYSALKHSNLGVYLVNLKAGAMLSPHVNPTATEYGIILRGSGTIQVVFPNGTAAMNAKVSEGDVFWIPRYFPFCQIASDGAPLEFFGFTTSARKNRPQFLVGKSSLLHSMRGPELAAAFGVSEEQLERIVKAQREAVILPTSPHREMEEINGKKWKGEEVLVMKRGLFA

SEQ ID NO: 1314 - protein, 168 aa, Crocus sativus (Saffron crocus)
MGKCQAVFLLVGALCVLSLAGVANAAENHFKVQGMVYCDTCRIQFMTRVSTIMEGATVKLECRNITAGTQTFKAEAVTDKVGQYSIPVHGDFQDDICEIELVKSPNSECSEVSHDVYAKQSAKVSLTSNNGEASDIRSANALGFMRKEPLKECPEVLKELDLYDVKAN

SEQ ID NO: 1315 - protein, 131 aa, Crocus sativus (Saffron crocus)
MSWQTYVDEHLMCDMDGHVLTSAAILGHDGSVWAQSAGFPELKPAEITAILNDFNEPGSLAPTGMYINGAKYMVIQGEPGVVIRGKKGSGGVTIKKSNMALIFGLYDEPMTPGQCNLVVERLGDYLIEQGY

SEQ ID NO: 1316 - protein, 246 aa, Cynodon dactylon (Bermuda grass)
AIGDKPGPNITATYGSKWLEARATFYGSNPRGAAPDDHGGACGYKDVDKPPFDGMTACGNEPIFKDGLGCRACYEIKCKEPVECSGEPVLVKITDKNYEHIAAYHFDLSGKAFGAMAKKGQEDKLRKAGELTLQFRRVKCKYPSGTKITFHIEKGSNDHYLALLVKYAAGDGNIVAVDIKPRDSDEFIPMKSSWGAIWRIDPKKPLKGPFSIRLTSEGGAHLVQDDVIPANWKPDTVYTSKLQFGA

SEQ ID NO: 1317 - protein, 244 aa, Cynodon dactylon (Bermuda grass)
AMGDKPGPNITATYGDKWLDAKATFYGSDPRGAAPDDHGGACGYKDVDKAPFDGMTGCGNEPIFKDGLACGSCYEIKCKEPAECSGEPVLIKITDKNYEHIAAYHFDLSGKAFGAMAKKGEEDKLRKAGELMLQFRRVKCEYPSDTKIAFHVEKGSSPNYLALLVKYAAGDGNIVGVDIKPKGSDEFLPMKQSWGAIWRIDPPKPLKGPFTIRLTSESGGHVEQDDVIPEDWKPDTVYKSKIQF

SEQ ID NO: 1318 - protein, 262 aa, Cynodon dactylon (Bermuda grass)
MLAVVAVVLASMVGGALCAMGDKPGPNITATYGDKWLDAKATFYGSDPRGAAPDDHGGACGYKDVDKAPFDGMTGCGNEPIFKDGLACGSCYEIKCKEPAECSGEPVLIKITDKNYEHIAAYHFDLSGKAFGAMAKKGEEDKLRKAGELMLQFRRVKCEYPSDTKIAFHVEKGSNPNYLALLVKYAAGDGNIVSVDIKSKGSDEFLPMKQSWGAIWRIDPPKPLKGPFTIRLTSESGGHVEQEDVIPEDWKPDTVYKSKIQF

SEQ ID NO: 1319 - protein, 262 aa, Cynodon dactylon (Bermuda grass)
MLAVVAVVLASMVGGALCAMGDKPGPNITATYGDKWLDAKATFYGSDPRGAAPDDHGGACGYKDVDKAPFDSMTGCGNEPIFKDGLGCGSCYEIKCKEPAECSGEPVLIKITDKNYEHIAAYHFDLSGKAFGAMAKKGEEDKLRKAGELMLQFRRVKCEYPSDTKIAFHVEKGSNPNYLALLVKYAAGDGNIVSVDIKSKGSDEFLPMKQSWGAIWRIDPPKPLKGPFTIRLTSESGGHVEQEDVIPEDWKPDTVYKSKIQF

SEQ ID NO: 1320 - protein, 244 aa, Cynodon dactylon (Bermuda grass)
AMGDKPGPNITATYGDKWLDAKATFYGSDPRGAAPDDHGGACGYKDVDKAPFDGMTGCGNEPIFKDGLACGSCYEIKCKEPAECSGEPVLIKITDKNYEHIAAYHFDLSGKAFGAMAKKGEEDKLRKAGELMLQFRRVKCEYPSDTKIAFHVEKGSSPNYLALLVKYAAGDGNIVGVDIKPKGSDEFLPMKQSWGAIWRMDPPKPLKGPFTIRLTSESGGHVEQDDVIPEDWKPDTVYKSKIQF

SEQ ID NO: 1321 - protein, 80 aa, Cynodon dactylon (Bermuda grass)
MADTGDMEHIFKRFDTNGDGKISLAELTDALRTLGSTSADEVQRMMAEIDTDGDGFIDFDEFISFCNANPGLMKDVAKVF

SEQ ID NO: 1322 - protein, 131 aa, Cynodon dactylon (Bermuda grass)
MSWQAYVDDHLMCEIEGHHLTSAAIIGHDGTVWAQSAAFPAFKPEEMANIMKDFDEPGFLAPTGLFLGPTKYMVIQGEPGAVIRGKKGSGGVTVKKTGQALVIGIYDEPMTPGQCNMVIEKLGDYLIEQGM

SEQ ID NO: 1323 - protein, 112 aa, Cynodon dactylon (Bermuda grass)
MATLTFPVLLATMVGHAWCVNIIFHVEESSPKFALSIKDSAKEITQVDVREHGADNMDPMTKSGDSWTIDKPLKGPLNIRLRAEGGGSRVQDDVIPENWKAGTDYPTKLHFG

SEQ ID NO: 1324 - protein, 118 aa, Cynodon dactylon (Bermuda grass)
MAKVIAIILVATMVTAALVPIECATVIDKELERKAKEALDAVIASAPPEKKSETTDAAVNLMAMSFICIGWAKKAGNEEEVVARINDFKKAADQVLAAAPAHKYKVMEETFKAVPCAL

SEQ ID NO: 1325 - protein, 153 aa, Cynodon dactylon (Bermuda grass)
STQLPSDEPLNGLNDKAIQDILNEHNMFRAKEHVPPLTWNTTLAKFSQDYAESKLKKDCKMVHSDSPYGENLMFGSGAISWKTTVDTWSDEKKSYHYGSNTCDQGKMCGHYTAVVWKDTTSVGCGRVLCDDKKDTMIMCSYWPPGNYENQKPY

SEQ ID NO: 1326 - protein, 34 aa, Dactylis glomerata (Orchard grass)
IPKVPPGPNITATYGDKWLDAKSTWYGKPTGAGP

SEQ ID NO: 1327 - protein, 36 aa, Dactylis glomerata (Orchard grass)
EAPVTFTVEKGSDEKNLALSIKYNKEGDSMAEVELK

SEQ ID NO: 1328 - protein, 96 aa, Dactylis glomerata (Orchard grass)
VKVTFKVEKGSDPKKLVLDIKYTRPGDTLAEVELRQHGSEEWEPLTKKGNLWEVKSSKPLTGPFNFRFMSKGGMRNVFDEVIPTAFKIGTTYTPEE

SEQ ID NO: 1329 - protein, 55 aa, Dactylis glomerata (Orchard grass)
DIYNYMEPYVSKVDPTDYFGNEQARTAWVDSGAQLGELSYGVLFNIQYVNYWFAP

SEQ ID NO: 1330 - protein, 265 aa, Holcus lanatus (Velvet grass)
MASSSRSVLLLVAALFAVFLGSAHGIAKVPPGPNITATYGDEWLDAKSTWYGKPTGAGPKDNGGACGYKDVDKPPFSGMTGCGNTPIFKDGRGCGSCFEIKCTKPESCSGEPVTVHITDDNEEPIAPYHFDLSGHAFGSMAKKGEEQKLRSAGELELKFRRVKCKYPDGTKPTFHVEKGSNPNYLALLVKYIDGDGDVVAVDIKEKGKDKWIELKESWGAVWRVDTPDKLTGPFTVRYTTEGGTKGEAEDVIPEGWKADTAYEAK

SEQ ID NO: 1331 - protein, 264 aa, Holcus lanatus (Velvet grass)
ADAGYTPAAPAAAGAGGKATTDEQKLLEDVNAGFKTAVAAAANVPPADKYKTFEAAFTASSKASIAAAATKAPGLIPQLNAATNTAYAAAQGATPEAKYDAFVTTLTEALRVIAGALEVHAVKPATEEVGAAKIPAGELQIVDKIDAAFRIAATAANAAPVNDKFTVFEGAFNKAIKESTGGAYEAYKFIPSLETAVKQAYAATVATAPEVKYTVFETALKKAITAMSEAQKEAKPVAAATGAATAAAGVAAGAATAAAGGYKV

SEQ ID NO: 1332 - protein, 240 aa, Holcus lanatus (Velvet grass)
QKLLEDVNASFKAAVAAAAKVPPADKYKTFLRAFTVLDRGSTEQSKAEETKMPELSSKLVDAYMAAFKASTGGTQEAKYDAFVTTLTEALRVIAGALEVHAVKPATEEVPAAKIPAGDLQVVDKIDASFKIAATAANAAPANDKFTVFETAFNKALKESTGGAYESYKFIPSLEAAVKQAYASTVAAAPEVKYAVFEAALTKAITAMSQAQKVAQPAAAATGAATVAAGAATTAAGGYKV

SEQ ID NO: 1333 - protein, 313 aa, Hordeum vulgare (Barley)
MANSGREHSAVPRRRNLVALVPRHGCYAEFSLYVCVGNINAPFPVFNRTTFIANAGIEAELEPHFLLLLFTFSSSSSFFTLLKTMIHFTDRSDNKNKAMMRGREFRKAFAEVLKGAATGQIAGQSSSMAKLSSSLELSYKLAYDKAQGATPEAKYDAYVATLTESLRVISGTLEVHSVKPAAEEVKGVPAGELKAIDQVDAAFRTAATAADAAPANDKFTVFESLQQGPSRKPRGGAYESYKFIPALEAAVKQAYAATVAAAPEVKFTVFQTALSKAINAMTQAGKVAKPAAAATATATVAAGAAATAGNYKV

SEQ ID NO: 1334 - protein, 131 aa, Hordeum vulgare (Barley)
MSWQTYVDDHLCCEIDGQHLTSAAILGHDGRVWVQSPNFPQFKPEEIAGIIKDFDEPGHLAPTGLFLGGTKYMVIQGEPGVVIRGKKGTGGITIKKTGMPLILGIYDEPMTPGQCNLVVERLGDYLVEQGF

SEQ ID NO: 1335 - protein, 146 aa, Hordeum vulgare (Barley)
PTSVAVDQGSMVSNSPGEWCWPGMGYPVYPFPRCRALVKSQCAGGQVVESIQKDCCRQIAAIGDEWCICGALGSMRGSMYKELGVALADDKATVAEVFPGCRTEVMDRAVASLPAVCNQYIPNTNGTDGVCYWLSYYQPPRQMSSR

SEQ ID NO: 1336 - protein, 289 aa, Hordeum vulgare (Barley)
ITTTTMQFNPSGLELERPQQLFPQWQPLPQQPPFLQQEPEQPYPQQQPLPQQQPFPQQPQLPHQHQFPQQLPQQQFPQQMPLQPQQQFPQQMPLQPQQQPQFPQQKPFGQYQQPLTQQPYPQQQPLAQQQPSIEEQHQLNLCKEFLLQQCTLDEKVPLLQSVISFLRPHISQQNSCQLKRQQCCQQLANINEQSRCPAIQTIVHAIVMQQQVQQQVGHGFVQSQLQQLGQGMPIQLQQQPGQAFVLPQQQAQFKVVGSLVIQTLPMLCNVHVPPYCSPFGSMATGSGGQ

SEQ ID NO: 1337 - protein, 263 aa, Lolium perenne (Rye grass)
MASSSSVLLVVALFAVFLGSAHGIAKVPPGPNITAEYGDKWLDAKSTWYGKPTGAGPKDNGGACGYKNVDKAPFNGMTGCGNTPIFKDGRGCGSCFEIKCTKPESCSGEAVTVTITDDNEEPIAPYHFDLSGHAFGSMAKKGEEQNVRSAGELELQFRRVKCKYPDDTKPTFHVEKASNPNYLAILVKYVDGDGDVVAVDIKEKGKDKWIELKESWGAVWRIDTPDKLTGPFTVRYTTEGGTKSEFEDVIPEGWKADTSYSAK

SEQ ID NO: 1338 - protein, 263 aa, Lolium perenne (Rye grass)
MASSSSVLLVVALFAVFLGSAHGIAKVPPGPNITAEYGDKWLDAKSTWYGKPTGAGPKDNGGACGYKDVDKAPFNGMTGCGNTPIFKDGRGCGSCFEIKCTKPESCSGEAVTVTITDDNEEPIAPYHFDLSGHAFGSMAKKGEEQKLRSAGELELQFRRVKCKYPDGTKPTFHVEKASNPNYLAILVKYVDGDGDVVAVDIKEKGKDKWIELKESWGAVWRIDTPDKLTGPFTVRYTTEGGTKSEVEDVIPEGWKADTSYSAK

SEQ ID NO: 1339 - protein, 97 aa, Lolium perenne (Rye grass)
AAPVEFTVEKGSDEKNLALSIKYNKEGDSMAEVELKEHGSNEWLALKKNGDGVWEIKSDKPLKGPFNFRFVSEKGMRNVFDDVVPADFKVGTTYKPE

SEQ ID NO: 1340 - protein, 97 aa, Lolium perenne (Rye grass)
TKVDLTVEKGSDAKTLVLNIKYTRPGDTLAEVELRQHGSEEWEPMTKKGNLWEVKSAKPLTGPMNFRFLSKGGMKNVFDEVIPTAFTVGKTYTPEYN

SEQ ID NO: 1341 - protein, 423 aa, Lolium perenne (Rye grass)
AVVCGRRYDVRIRVRSGGHDYEGLSYRSLQPENFAVVDLNQMRAVLVDGKARTAWVDSGAQLGELYYAISKYSRTLAFPAGVCPTIGVGGNLAGGGFGMLLRKYGIAAENVIDVKLVDANGKLHDKKSMGDDHFWAVRGGGGESFGIVVSWQVKLLPVPPTVTIFKIPKSVSEGAVDIINKWQLVAPQLPADLMIRIIAMGPKATFEAMYLGTCKTLTPMMQSKFPELGMNASHCNEMSWIESIPFVHLGHRDSLEGDLLNRNNTFKPFAEYKSDYVYEPFPKSVWEQIFGTWLVKPGAGIMIFDPYGATISATPEAATPFPHRKGVLFNIQYVNYWFAPGAGAAPLSWSKEIYNYMEPYVSKNPRQAYANYRDIDLGRNEVVNGVSTYSSGKVWGQKYFKGNFERLAITKGKVDPTDYFRNE

SEQ ID NO: 1342 - protein, 339 aa, Lolium perenne (Rye grass)
MAVQKHTVALFLAVALVAGPAASYAADAGYAPATPATPAAPATAATPATPATPATPAAVPSGKATTEEQKLIEKINAGFKAAVAAAAVVPPADKYKTFVETFGTATNKAFVEGLASGYADQSKNQLTSKLDAALKLAYEAAQGATPEAKYDAYVATLTEALRVIAGTLEVHAVKPAAEEVKVGAIPAAEVQLIDKVDAAYRTAATAANAAPANDKFTVFENTFNNAIKVSLGAAYDSYKFIPTLVAAVKQAYAAKQATAPEVKYTVSETALKKAVTAMSEAEKEATPAAAATATPTPAAATATATPAAAYATATPAAATATATPAAATATPAAAGGYKV

SEQ ID NO: 1343 - protein, 134 aa, Lolium perenne (Rye grass)
  misc_feature (103)..(103): Xaa can be any naturally occurring amino acid
DKGPGFVVTGRVYCDPCRAGFETNVSHNVEGATVAVDCRPFDGGESKLKAEATTDKDGWYKIEIDQDHQEEICEVVLAKSPDKSCSEIEEFRDRARVPLTSNXGIKQQGIRYANPIAFFRKEPLKECGGILQAY

SEQ ID NO: 1344 - protein, 131 aa, Musa acuminata (Banana)
MSWQAYVDDHLLCDIDGQCLTAAAIVGHDGSVWAQSDAFPQCKPEEIAAIMKDFDEPGSLAPTGLYLGGTKYMVIQGEPGAVIRGKKGSGGVTIKKTNLALIIGIYNEPMTPGQCNMVVERLGDYLFDQGF

SEQ ID NO: 1345 - protein, 318 aa, Musa acuminata (Banana)
MKALLLVIFTLASSLGAFAEQCGRQAGGALCPGGLCCSQYGWCGNTDPYCGQGCQSQCGGSGGSGGGSVASIISSSLFEQMLKHRNDAACPGKGFYTYNAFIAAANSFSGFGTTGDDAKKKREIAAFLAQTSHETTGGWATAPDGPYAWGYCFVQEQNPSSDYCVASSQWPCAAGKKYYGRGPIQISFNYNYGPAGRAIGSDLLNNPDLVATDATISFKTALWFWMTPQSPKPSCHDVITGSWTPSNADQAAGRLPGYGVTTNIINGGLECGKGYDARVADRIGFYKRYCDLLGVSYGDNLDCYNQRPFASTAATATF

SEQ ID NO: 1346 - protein, 39 aa, Musa acuminata (Banana)
ITCSKVYGDIISCVGYIKGGPIACVGYLKGGPLQQYVHN

SEQ ID NO: 1347 - protein, 200 aa, Musa acuminata (Banana)
ATFEIVNRCSYTVWAAAVPGGGRQLNQGQSWTINVNAGTTGGRIWGRTGCSFDGSGRGRCQTGDCGGVLSCTAYGNPPNTLAEFALNQFNNLDFFDISLVDGFNVPMDFSPTSGGCRGIRCAADINGQCPGALKAPGGCNNPCTVFKTDQYCCNSGACSPTDYSQFFKRNCPDAYSYPKDDQTTTFTCPGGTNYRVVFCP

SEQ ID NO: 1348 - protein, 267 aa, Oryza sativa (Rice)
MASSSLLLACVVVAAMVSAVSCGPPKVPPGPNITTSYGDKWLEAKATWYGAPKGAGPKDNGGACGYKDVDKAPFLGMNSCGNDPIFKDGKGCGSCFEIKCSKPEACSDKPALIHVTDMNDEPIAAYHFDLSGLAFGAMAKDGKDEELRKAGIIDTQFRRVKCKYPADTKITFHIEKASNPNYLALLVKYVAGDGDVVEVEIKEKGSEEWKALKESWGAIWRIDTPKPLKGPFSVRVTTEGGEKIIAEDAIPDGWKADSVYKSNVQAK

SEQ ID NO: 1349 - protein, 131 aa, Oryza sativa (Rice)
MSWQTYVDEHLMCEIEGHHLTSAAIVGHDGTVWAQSAAFPQFKPEEMTNIMKDFDEPGFLAPTGLFLGPTKYMVIQGEPGAVIRGKKGSGGITVKKTGQALVVGIYDEPMTPGQCNMVVERLGDYLVEQGL

SEQ ID NO: 1350 - protein, 265 aa, Paspalum notatum (Bahia grass)
MGSLAKIVAVAAVLAALVAGGSCGPPKVPPGPNITTNYNGKWLPAKATWYGQPNGAGPDDNGGACGIKNVNLPPYNGFTACGNPPIFKDGKGCGSCYEIRCNKPECSGQPVTVFITDMNYEPIAPYHFDLSGKAFGAMAKPGLNDKLRHYGIFDLEFRRVRCKYQGGQKIVFHVEKGSNPNYLAMLVKFVADDGDIVLMELKEKSSDWKPMKLSWGAIWRMDTPKALVPPFSIRLTSESGKKVIAQDVIPVNWKPDTVYNSNVQF

SEQ ID NO: 1351 - protein, 269 aa, Phalaris aquatica (Canary grass)
MMKMVCSSSSSSLLVVAALLAVFVGSAQGIAKVPPGPNITAEYGDKWLDAKSTWYGKPTGAGPKDNGGACGYKDVDKAPFNGMTGCGNTPIFKDGRGCGSCFELKCSKPESCSGEPITVHITDDNEEPIAPYHFDLSGHAFGSMAKKGEEENVRGAGELELQFRRVKCKYPDGTKPTFHVEKGSNPNYLALLVKYVDGDGDVVAVDIKEKGKDKWIELKESWGAIWRIDTPDKLTGPFTVRYTTEGGTKAEFEDVIPEGWKADTHDASK

SEQ ID NO: 1352 - protein, 320 aa, Phalaris aquatica (Canary grass)
MAVQKYTMALFLAVALVAGPAAPTPPTPRTPPLLPPPRARDKATLTSRSVEDINAASRRPWWASVPPADKFKTFADHVLCVPNADVTSAATKAPQLKAKLDAAYRVAYEAAEGSTPEAKYDAFIAALTEALRVIAGAFEVHAVKPATEEVVADPVGELQIVDKIDAAFKIAATAANSAPANDKFTVFEGAFNKAIKESTAGAYETYKFIPSLEAAVKQAYGATVARAPEVKYAVFEAGLTKAITAMSEAQKVAKPPLSPQPPQVLPLAAGGAATVAAASDVRVCRSHGTLQDACLLRCRGGCQPVVWRGGSHRARGGYKV

SEQ ID NO: 1353 - protein, 263 aa, Phleum pratense (Timothy)
MASSSSVLLVVALFAVFLGSAHGIPKVPPGPNITATYGDKWLDAKSTWYGKPTAAGPKDNGGACGYKDVDKPPFSGMTGCGNTPIFKSGRGCGSCFEIKCTKPEACSGEPVVVHITDDNEEPIAAYHFDLSGIAFGSMAKKGDEQKLRSAGEVEIQFRRVKCKYPEGTKVTFHVEKGSNPNYLALLVKFVAGDGDVVAVDIKEKGKDKWIALKESWGAIWRIDTPEVLKGPFTVRYTTEGGTKGEAKDVIPEGWKADTAYESK

SEQ ID NO: 1354 - protein, 263 aa, Phleum pratense (Timothy)
MASSSSVLLVVVLFAVFLGSAYGIPKVPPGPNITATYGDKWLDAKSTWYGKPTGAGPKDNGGACGYKDVDKPPFSGMTGCGNTPIFKSGRGCGSCFEIKCTKPEACSGEPVVVHITDDNEEPIAPYHFDLSGHAFGAMAKKGDEQKLRSAGELELQFRRVKCKYPEGTKVTFHVEKGSNPNYLALLVKYVNGDGDVVAVDIKEKGKDKWIELKESWGAIWRIDTPDKLTGPFTVRYTTEGGTKTEAEDVIPEGWKADTSYESK

SEQ ID NO: 1355 - protein, 122 aa, Phleum pratense (Timothy)
MSMASSSSSSLLAMAVLAALFAGAWCVPKVTFTVEKGSNEKHLAVLVKYEGDTMAEVELREHGSDEWVAMTKGEGGVWTFDSEEPLQGPFNFRFLTEKGMKNVFDDVVPEKYTIGATYAPEE

SEQ ID NO: 1356 - protein, 508 aa, Phleum pratense (Timothy)
SSCEVALSYYPTPLAKEDFLRCLVKEIPPRLLYAKSSPAYPSVLGQTIRNSRWSSPDNVKPIYIVTPTNASHIQSAVVCGRRHGVRIRVRSGGHDYEGLSYRSLQPEEFAVVDLSKMRAVWVDGKARTAWVDSGAQLGELYYAIHKASPVLAFPAGVCPTIGVGGNFAGGGFGMLLRKYGIAAENVIDVKLVDANGTLHDKKSMGDDHFWAVRGGGGESFGIVVAWKVRLLPVPPTVTVFKIPKKASEGAVDIINRWQVVAPQLPDDLMIRVIAQGPTATFEAMYLGTCQTLTPMMSSKFPELGMNASHCNEMSWIQSIPFVHLGHRDNIEDDLLNRNNTFKPFAEYKSDYVYEPFPKEVWEQIFSTWLLKPGAGIMIFDPYGATISATPEWATPFPHRKGVLFNIQYVNYWFAPGAGAAPLSWSKEIYNYMEPYVSKNPRQAYANYRDIDLGRNEVVNDVSTFSSGLVWGQKYFKGNFQRLAITKGKVDPTDYFRNEQSIPPLIQKY

SEQ ID NO: 1357 - protein, 508 aa, Phleum pratense (Timothy)
SSCQVAFSYFPPPAAKEDFLGCLVKEIPPRLLYAKSSPAYPSVLGQTIRNSRWSSPDNVKPLYIITPTNVSHIQSAVVCGRRHSVRIRVRSGGHDYEGLSYRSLQPETFAVVDLNKMRAVWVDGKARTAWVDSGAQLGELYYAIYKASPTLAFPAGVCPTIGVGGNFAGGGFGMLLRKYGIAAENVIDVKLVDANGKLHDKKSMGDDHFWAVRGGGGESFGIVVAWQVKLLPVPPTVTIFKISKTVSEGAVDIINKWQVVAPQLPADLMIRIIAQGPKATFEAMYLGTCKTLTPLMSSKFPELGMNPSHCNEMSWIQSIPFVHLGHRDALEDDLLNRNNSFKPFAEYKSDYVYQPFPKTVWEQILNTWLVKPGAGIMIFDPYGATISATPESATPFPHRKGVLFNIQYVNYWFAPGAAAAPLSWSKDIYNYMEPYVSKNPRQAYANYRDIDLGRNEVVNDVSTYASGKVWGQKYFKGNFERLAITKGKVDPTDYFRNEQSIPPLIKKY

SEQ ID NO: 1358 - protein, 312 aa, Phleum pratense (Timothy)
MAVHQYTVALFLAVALVAGPAASYAADLGYGPATPAAPAAGYTPATPAAPAEAAPAGKATTEEQKLIEKINAGFKAALAAAAGVQPADKYRTFVATFGAASNKAFAEGLSGEPKGAAESSSKAALTSKLDAAYKLAYKTAEGATPEAKYDAYVATLSEALRIIAGTLEVHAVKPAAEEVKVIPAGELQVIEKVDAAFKVAATAANAAPANDKFTVFEAAFNDAIKASTGGAYESYKFIPALEAAVKQAYAATVATAPEVKYTVFETALKKAITAMSEAQKAAKPAAAATATATAAVGAATGAATAATGGYKV

SEQ ID NO: 1359 - protein, 286 aa, Phleum pratense (Timothy)
ADLGYGPATPAAPAAGYTPATPAAPAGADAAGKATTEEQKLIEKINAGFKAALAGAGVQPADKYRTFVATFGPASNKAFAEGLSGEPKGAAESSSKAALTSKLDAAYKLAYKTAEGATPEAKYDAYVATLSEALRIIAGTLEVHAVKPAAEEVKVIPAGELQVIEKVDAAFKVAATAANAAPANDKFTVFEAAFNDEIKASTGGAYESYKFIPALEAAVKQAYAATVATAPEVKYTVFETALKKAITAMSEAQKAAKPAAAATATATAAVGAATGAATAATGGYKV

SEQ ID NO: 1360 - protein, 312 aa, Phleum pratense (Timothy)
MAVHQYTVALFLAVALVAGPAGSYAADLGYGPATPAAPAAGYTPATPAAPAGAEPAGKATTEEQKLIEKINAGFKAALAAAAGVPPADKYRTFVATFGAASNKAFAEGLSGEPKGAAESSSKAALTSKLDAAYKLAYKTAEGATPEAKYDAYVATVSEALRIIAGTLEVHAVKPAAEEVKVIPAGELQVIEKVDAAFKVAATAANAAPANDKFTVFEAAFNDAIKASTGGAYESYKFIPALEAAVKQAYAATVATAPEVKYTVFETALKKAITAMSEAQKAAKPAAAATATATAAVGAATGAATAATGGYKV

SEQ ID NO: 1361 - protein, 276 aa, Phleum pratense (Timothy)
ADLGYGGPATPAAPAEAAPAGKATTEEQKLIEKINDGFKAALAAAAGVPPADKYKTFVATFGAASNKAFAEGLSAEPKGAAESSSKGALTSKLEAAYKLAYKTSEGATPEAKYDAYVATLSEALRIIAGTLEVHAVKPAAEEVKVIPAGELQFIEKVDSALKVAATAANAAAANDKFTVFEAAFNHAIKASTGGAYESYKFIPALEAAVKQAYAATVATAPEVKYTVFETALKKAITAMSEAQKAAKPATEATATATAAVGAATGAATAATGGYKV

SEQ ID NO: 1362 - protein, 276 aa, Phleum pratense (Timothy)
ADLGYGGPATPAAPAEAAPAGKATTEEQKLIEKINDGFKAALAAAAGVPPADKYKTFVATFGAASNKAFAEGLSAEPKGAAESSSKAALTSKLDAAYKLAYKTAEGATPEAEYDAYVATLSEALRIIAGTLEVHAVKPAAEEVKVIPAGELQVIEKVDSALKVAATAANAAPANDKFTVFEAAFNNAIKASTGGAYESYKFIPALEAAVKQAYAATVATAPEVKYTVFETALKKAITATSEAQKAAKPATEATATATAAVGAATGAATAATGGYKV

SEQ ID NO: 1363 - protein, 276 aa, Phleum pratense (Timothy)
ADLGYGGPATPAAPAEAAPAGKATTEEQKLIEKINDGFKAALAAAAGVPPADKYKTFVATFGAASNKAFAEGLSAEPKGAAESSSKAALTSKLDAAYKLAYKTAEGATPEAKYDAYVATLSEALRIIAGTLEVHAVKPAAEEVKVIPAGELQVIEKVDSAFKVAATAANAAPANDKFTVFEAAFNNAIKASTGGAYESYKFIPALEAAVKQAYAATVATAPEVKYTVFETALKKAITAMSEAQKAAKPATEATATATAAVGAATGAATAATGGYKV

SEQ ID NO: 1364 - protein, 276 aa, Phleum pratense (Timothy)
ADLGYGGPATPAAPAEAAPAGKATTEEQKLIEKINDGFKAALAAAAGVPPADKYKTFVATFGAASNKAFAEGLSAEPKGAAESSSKAALTSKLDAAYKLAYKTAEGATPEAKYDAYVATLSEALRIIAGTLEVHAVKPAAEEVKVIPAGELQVIEKVDSAFKVAATAANAAPANDKFTVFEAAFNNAIKASTGGAYESYKFIPALEAAVKQAYAATVATAPEVKYTVFETALKKAFTAMSEAQKAAKPATEATATATAAVGAATGAATAATGGYKV

SEQ ID NO: 1365 - protein, 284 aa, Phleum pratense (Timothy)
ADLGYGPATPAAPAAGYTPAAPAGAEPAGKATTEEQKLIEKINAGFKAALAAAAGVPPADKYRTFVATFGAASNKAFAEGLSGEPKGAAESSSKAALTSKLDAAYKLAYKTAEGATPEAKYDAYVATLSEALRIIAGTLEVHAVKPAAEEVKVIPAGELQVIEKVDAAFKVAATAANAAPANDKFTVFEAAFNNAIKASTGGAYESYKFIPALEAAVKQAYAATVATAPEVKYTVFETALKKAITAMSEAQKAAKPAAAATATATSAVGAATGAATAATGGYKV

SEQ ID NO: 1366 - protein, 284 aa, Phleum pratense (Timothy)
AAAAVPRRGPRGGPGRSYTADAGYAPATPAAAGAAAGKATTEEQKLIEDINVGFKAAVAAAASVPAADKFKTFEAAFTSSSKAAAAKAPGLVPKLDAAYSVAYKAAVGATPEAKFDSFVASLTEALRVIAGALEVHAVKPVTEEPGMAKIPAGELQIIDKIDAAFKVAATAAATAPADDKFTVFEAAFNKAIKESTGGAYDTYKCIPSLEAAVKQAYAATVAAAPQVKYAVFEAALTKAITAMSEVQKVSQPATGAATVAAGAATTAAGAASGAATVAAGGYKV

SEQ ID NO: 1367 - protein, 281 aa, Phleum pratense (Timothy)
AVPRRGPRGGPGRSYAADAGYAPATPAAAGAEAGKATTEEQKLIEDINVGFKAAVAAAASVPAGDKFKTFEAAFTSSSKAATAKAPGLVPKLDAAYSVAYKAAVGATPEAKFDSFVASLTEALRVIAGALEVHAVKPVTEEPGMAKIPAGELQIIDKIDAAFKVAATAAATAPADDKFTVFEAAFNKAIKESTGGAYDTYKCIPSLEAAVKQAYAATVAAAPQVKYAVFEAALTKAITAMSEVQKVSQPATGAATVAAGAATTATGAASGAATVAAGGYKV

SEQ ID NO: 1368 - protein, 295 aa, Phleum pratense (Timothy)
SVKRSNGSAEVHRGAVPRRGPRGGPGRSYAADAGYAPATPAAAGAEAGKATTEEQKLIEDINVGFKAAVAAAASVPAADKFKTFEAAFTSSSKAATAKAPGLVPKLDAAYSVAYKAAVGATPEAKFDSFVASLTEALRVIAGALEVHAVKPVTEEPGMAKIPAGELQIIDKIDAAFKVAATAAATAPADDKFTVFEAAFNKAIKESTGGAYDTYKCIPSLEAAVKQAYAATVAAAPQVKYAVFEAALTKAITAMSEVQKVSQPATGAATVAAGAATTAAGAASGAATVAAGGYKV

SEQ ID NO: 1369 - protein, 290 aa, Phleum pratense (Timothy)
MAVQKYTVALFLAVALVAGPAASYAADAGYAPATPAAAGAEAGKATTEEQKLIEDINVGFKAAVAAAASVPAADKFKTFEAAFTSSSKAATAKAPGLVPKLDAAYSVAYKAAVGATPEAKFDSFVASLTEALRVIAGALEVHAVKPVTEDPAWPKIPAGELQIIDKIDAAFKVAATAAATAPADDKFTVFEAAFNKAIKESTGGAYDTYKCIPSLEAAVKQAYAATVAAAPQVKYAVFEAALTKAITAMSEVQKVSQPATGAATVAAGAATTATGAASGAATVAAGGYKV

SEQ ID NO: 1370 - protein, 287 aa, Phleum pratense (Timothy)
MAVQKYTVALFLAVALVAGPAASYAADAGYAPATPAAAGAEAGKATTEEQKLIEDINVGFKAAVAAAASVPAADKFKTFEAAFTSSSKAATAKAPGLVPKLDAAYSVSYKAAVGATPEAKFDSFVASLTEALRVIAGALEVHAVKPVTEEPGMAKIPAGELQIIDKIDAAFKVAATAAATAPADTVFEAAFNKAIKESTGGAYDTYKCIPSLEAAVKQAYAATVAAAPQVKYAVFEAALTKAITAMSEVQKVSQPATGAATVAAGAATTAAGAASGAATVAAGGYKV

SEQ ID NO: 1371 - protein, 132 aa, Phleum pratense (Timothy)
MVAMFLAVAVVLGLATSPTAEGGKATTEEQKLIEDVNASFRAAMATTANVPPADKYKTFEAAFTVSSKRNLADAVSKAPQLVPKLDEVYNAAYNAADHAAPEDKYEAFVLHFSEALRIIAGTPEVHAVKPGA

SEQ ID NO: 1372 - protein, 138 aa, Phleum pratense (Timothy)
MAAHKFMVAMFLAVAVVLGLATSPTAEGGKATTEEQKLIEDINASFRAAMATTANVPPADKYKTFEAAFTVSSKRNLADAVSKAPQLVPKLDEVYNAAYNAADHAAPEDKYEAFVLHFSEALHIIAGTPEVHAVKPGA

SEQ ID NO: 1373 - protein, 78 aa, Phleum pratense (Timothy)
MADDMERIFKRFDTNGDGKISLSELTDALRTLGSTSADEVQRMMAEIDTDGDGFIDFNEFISFCNANPGLMKDVAKVF

SEQ ID NO: 1374 - protein, 143 aa, Phleum pratense (Timothy)
DKGPGFVVTGRVYCDPCRAGFETNVSHNVQGATVAVDCRPFNGGESKLKAEATTDGLGWYKIEIDQDHQEEICEVVLAKSPDTTCSEIEEFRDRARVPLTSNNGIKQQGIRYANPIAFFRKEPLKECGGILQAYDLRDAPETP

SEQ ID NO: 1375 - protein, 131 aa, Phleum pratense (Timothy)
MSWQTYVDEHLMCEIEGHHLASAAILGHDGTVWAQSADFPQFKPEEITGIMKDFDEPGHLAPTGMFVAGAKYMVIQGEPGRVIRGKKGAGGITIKKTGQALVVGIYDEPMTPGQCNMVVERLGDYLVEQGM

SEQ ID NO: 1376 - protein, 131 aa, Phleum pratense (Timothy)
MSWQTYVDEHLMCEIEGHHLASAAILGHDGTVWAQSADFPQFKPEEITGIMKDFDEPGHLAPTGMFVAGAKYMVIQGEPGAVIRGKKGAGGITIKKTGQALVVGIYDEPMTPGQCNMVVERLGDYLVEQGM

SEQ ID NO: 1377 - protein, 131 aa, Phleum pratense (Timothy)
MSWQTYVDEHLMCEIEGHHLASAAIFGHDGTVWAQSADFPQFKPEEITGIMKDLDEPGHLAPTGMFVAAAKYMVIQGEPGAVIRGKKGAGGITIKKTGQALVVGIYDEPMTPGQCNMVVERLGDYLVEQGM

SEQ ID NO: 1378 - protein, 394 aa, Phleum pratense (Timothy)
GKKEEKKEEKKESGDAASGADGTYDITKLGAKPDGKTDCTKEVEEAWASACGGTGKNTIVIPKGDFLTGPLNFTGPCKGDSVTIKLDGNLLSSNDLAKYKANWIEIMRIKKLTITGKGTLDGQGKAVWGKNSCAKNYNCKILPNTLVLDFCDDALIEGITLLNAKFFHMNIYECKGVTVKDVTITAPGDSPNTDGIHIGDSSKVTITDTTIGTGDDCISIGPGSTGLNITGVTCGPGHGISVGSLGRYKDEKDVTDITVKNCVLKKSTNGLRIKSYEDAKSPLTASKLTYENVKMEDVGYPIIIDQKYCPNKICTSKGDSARVTVKDVTFRNITGTSSTPEAVSLLCSDKQPCNGVTMNDVKIEYSGTNNKTMAVCTNAKVTAKGVSEANTCAA

SEQ ID NO: 1379 - protein, 131 aa, Phoenix dactylifera (Date palm)
MSWQAYVDEHLMCEIDGHHLTAAAILGHDGSVWAQSSSFPQFKSEEITNIMNDFNEPGSLAPTGLYLGSTKYMVIQGEPGAVIRGKKGSGGVTVKKTNQALIFGIYEEPMTPGQCNMVVERLGDYLIEQGM

SEQ ID NO: 1380 - protein, 263 aa, Poa pratensis (Kentucky blue grass)
MASSSSVLLVVALFAVFLGTAHGIAKVPPGPNITATYGDKWLDAKSTWYGKPTGAGPKDNGGACGYKDVDKAPFSGMTGCGNTPIFKSGRGCGSCFEIKCTKPESCSGEPVLVHITDDNEEPIAAYHFDLSGKAFGAMAKKGEEQKLRSAGELELKFRRVKCEYPEGTKVTFHVEKGSNPNYLALLVKYVTGDGDVVAVDIKEKGKDKWIELKESWGSIWRVDTPDKLTGPFTVRYTTEGGTKGEAEDVIPEGWKADTAYASK

SEQ ID NO: 1381 - protein, 303 aa, Poa pratensis (Kentucky blue grass)
MAVQKYTVALFLTVALVAGPAASYAADAGYAPATPAAAGAAAGKITPTQEQKLMEDINVGFKAAVAAAAGAPPADKFKTFQAAFSASVEASAAKLNAAQAPGFVSHVAATSDATYKAAVGATPEAKFDSFVAAFTEALRIIAGVLKVHAVKPITEETGAAKIPAGEQQIIDKIDAAFKVAATAANAAPANDKFTVFEAAFNNAIKESTGGAYDTYKSIPSLEAAVKQAYAATIAAAPEVKFAVFKAALTKAITAMAEVQKVSKPVAGAATVAAGAATAATGAATGAAGAATGAATVSAGGYKV

SEQ ID NO: 1382 - protein, 292 aa, Secale cereale (Rye)
MAVQQYTVALFLAVALVAGPAVSYGTYAPAAPGTQPKATTPEQKLMENINNGFKAAVEAAAAVAPADKYKTFQTTFIKGSNKAFADVLTAAASGQIPAQSDSMARLSTSLESSYKLAYDSAEGATPETKYDTYVASLTESLRVISGAFEVHAVKPASEEVKGVPAPQLKVVDQIDAAYRTAATAANAAPTNDKFNVFESSFNKAIKENTGGAYASYTFVPALESAVKQAYAATVASAPEVKYAVFQAALSKAINAMVEAEKDAKPAAAAAATATATATVGAAAGAAAGGYKA

SEQ ID NO: 1383 - protein, 23 aa, Secale cereale (Rye)
NMQVNPSGQVQWPQQQPFPQPQQ

SEQ ID NO: 1384 - protein, 29 aa, Secale cereale (Rye)
  misc_feature (24)..(24): Xaa can be any naturally occurring amino acid
  misc_feature (28)..(28): Xaa can be any naturally occurring amino acid
NMQVGPSGQVSWPQQQPLPQPQQXVYQXP

SEQ ID NO: 1385 - protein, 26 aa, Secale cereale (Rye)
EQCYGESCRVGKSISNNPVPACREYV

SEQ ID NO: 1386 - protein, 429 aa, Sorghum halepense (Johnson grass)
MPPVTPGQATLILDHVLGDPSLPAAVAKALLAALPHPSDPTPRLCRAVVLRALAADPVSETSLQNLHFLASLTASPSAAASRIATAHIAVAAFLAASAPDFDAAAMKLFERPSGRVRRAVDEGGPLASDVAMATVDQFEAAVGNSSSQTILRGLWGNRAAAEDRVRDLVAAEWAAIGPSKLVTAAERIVGDGALETWRAADEVTRAKLRILAGEEKTREILAKLEETTSSANPISTPAFEKMIDALKTSCADLHSVVEDPLPAAKAVADEVLAARMDKGVSLNAEELGGQPTACGAAGPSTLNDKDHGPSRGKRQNLMDRNPTARTSQWDDSPDLEGSESSSPRLQLPSPRRIPPSPLPPPENKSNRRRARKWSMFEEETLRKGVEQYGMGNWKGILDNNPDVFMGRTPVDLKDKWRNMKRLGYQQPRA

SEQ ID NO: 1387 - protein, 266 aa, Sorghum halepense (Johnson grass)
MGSLANKIVAMAAVLAALVTGGSCAPKKFPPGPNITTNYNGQWLSARATWYGQPNGAGPDDNGGACGIKNVNLPPYNGFTACGNVPIFKDGKGCGSCYEVRCKEMPECSGNPITVFITDMNYEPIAPYHFDFSGKAFGSLAKPGLNDKLRHCGIMNVEFRRVRCKLGGKIMFHVEKGSNPNYLAVLVKNVADDGNIVLMELEDKASPGFKPMKQSWGAVWRFDTPKPVKGPFSIRLTSESGKKLVAPNVIPATWKPDTLYNSNIQF

SEQ ID NO: 1388 - protein, 119 aa, Sorghum halepense (Johnson grass)
MASSSSFLLAMAALAALLAVGSCSTLMTWTIGKDSTSTRLVLVASADVSEVAVKDKGATDFSDDLKESPAKTFTYESKEPIKGPLSVRFAVKGQGYRTTDDVIPADFKPGSVYKTKEQV

SEQ ID NO: 1389 - protein, 121 aa, Sorghum halepense (Johnson grass)
MASSSSFCFLLAVVALAALFAIGSCGTTLTIEVGKDSTSTKLSLITNVAISEVSVKPKGATDFTDDLKESEPKTFTLDSKEPIEGPIAFRFLAKGGGYRVVDNAIPADFKAGSVYKTTEQV

SEQ ID NO: 1390 - protein, 422 aa, Sorghum halepense (Johnson grass)
MALGSNAMRVFFLLAMVVCAAHAAGKAAPKEKEKGKDDKSGGAPAEAPSGSAGGSDISKLGAKGDGKTDSTKALNEAWAAACGKEGPQTLMIPKGDYLTGPLNFSGPCKGSVTIQLDGNLLGTTDLSAYKTNWIEIEHVDNLVISGKGTLDGQGKQVWDNNKCAQKYDCKILPNSLVLDYVNNGEVSGITLLNAKFFHMNVFQCKGVTIKDVTVTAPGDSPNTDGIHIGDSSKVTITGTTIGVGDDCISIGPGSTGINVTGVTCGPGHGISVGSLGRYKDEKDVTDINVKDCTLKKTSNGVRIKSYEDAACVITASKLHYENIAMDDVANPIIIDMKYCPNKICTAKGDSKVTVKDVTFKNITGTSSTPEAVSLLCSDKIPCSGVTMDNIKVEYKGTNNKTMAVCQNAKGSATGCLKELACF

SEQ ID NO: 1391 - protein, 410 aa, Sorghum halepense (Johnson grass)
MACTGNAMRAFFLLAFVCAAHAGKDAPAKDGDAKAASGPGGSFDISKLGASGDGKKDSTKAVQEAWTSACGGTGKQTILIPKGDYLVGPLNFTGPCKGDVTIQVDGNLLATTDLSQYKGNWIEILRVDNLVITGKGKLDGQGPAVWSKNSCAKKYDCKILPNSLVLDYVNNGEVSGITLLNAKFFHMNVFQCKGVTIKDVTVTAPGDSPNTDGIHIGDSSKVTITGTTIGVGDDCISIGPGSTGINVTGVTCGPGHGISVGSLGRYKDEKDVTDINVKDCTLKKTSNGVRIKSYEDAACVITASKLHYENIAMDDVANPIIIDMKYCPNKICTAKGDSKVTVKDVTFKNITGTSSTPEAVSLLCSDKIPCSGVTMDNIKVEYKGTNNKTMAVCQNAKGSATGCLKELACF

SEQ ID NO: 1392 - protein, 131 aa, Triticum aestivum (Wheat)
MSWQTYVDDHLCCEIDGQHLTSAAILGHDGSVWTESPNFPKFKPEEIAGIVKDFEEPGHLAPTGLFLGGTKYMVIQGEPGVVIRGKKGTGGITIKKTGMALILGIYDEPMTPGQCNLVVERLGDYLIDQGY

SEQ ID NO: 1393 - protein, 131 aa, Triticum aestivum (Wheat)
MSWQAYVDDHLCCEIDGQHLTSAAILGHDGSVWAESPNFPKFKPEEIAGIVKDFEEPGHLAPTGLFLGGTKYMVIQGEPGVVIRGKKGTGGITIKKTGMALILGIYDEPMTPGQCNLVVERLGDYLIDQGY

SEQ ID NO: 1394 - protein, 131 aa, Triticum aestivum (Wheat)
MSWKAYVDDHLCCEIDGQNLTSAAILGHDGSVWAQSPNFPQFKPEENAGIVKDFEEPGHLAPTGLFLGGTKYMVIQGEPGVVIRGKKGTGGITIKKTGMALILGIYDEPMTPGQCNLVVERLGDYLIDQGY

SEQ ID NO: 1395 - protein, 131 aa, Triticum aestivum (Wheat)
MSWKAYVDDHLCCEIDGQHLTSAAILGHDGSVWAQSPNFPQFKPEEIAGIVKDFEEPGHLAPTGLFLGGTKYMVIQGEPGVVIRGKKGTGGITIKKTGMALILGIYDEPMTPGQCNLVVERLGDYLIDQGY

SEQ ID NO: 1396 - protein, 92 aa, Triticum aestivum (Wheat)
ISCSQVDSTLMPCLQYVQQGGSPARGCCTGIQNLLAEANNSPDRRTICGCLKNVANGASGGPYITRAAALPSKCNVALPYKISPSVDCNTVH

SEQ ID NO: 1397 - protein, 121 aa, Triticum aestivum (Wheat)
SGPWSWCDPATGYKVSALTGCRAMVKLQCVGSQVPEAVLRDCCQQLADVNNEWCRCEDLSSMLRSVYQELGAREGKEVLPGCRKEVMKLTAASVPEVRKVPIPNPSGDRAGVCYWAAYPDV

SEQ ID NO: 1398 - protein, 212 aa, Triticum aestivum (Wheat)
MKMMSTRALALGAAAVLAFAAATAQAQRCGEQGSNMECPNNLCCSQYGYCGMGGDYCGKGCQNGACWTSKRCGSQAGGATCTNNQCCSQYGYCGFGAEYCGAGCQGGPCRADIKCGSQAGGKLCPNNLCCSQWGFCGLGSEFCGGGCQSGACSTDKPCGKDAGGRVCTNNYCCSKWGSCGIGPGYCGAGCQSGGCDGVFAEAITANSTLLQE

SEQ ID NO: 1399 - protein, 439 aa, Triticum aestivum (Wheat)
MKTFIIFVLLAMAMNIASASRLLSPRGKELHTPQEQFPQQQQFPQPQQFPQQQIPQQHQIPQQPQQFPQQQQFLQQQQIPQQQIPQQHQIPQQPQQFPQQQQFPQQHQSPQQQFPQQQFPQQKLPQQEFPQQQISQQPQQLPQQQQIPQQPQQFLQQQQFPQQQPPQQHQFPQQQLPQQQQIPQQQQIPQQPQQIPQQQQIPQQPQQFPQQQFPQQQFPQQQFPQQEFPQQQQFPQQQIARQPQQLPQQQQIPQQPQQFPQQQQFPQQQSPQQQQFPQQQFPQQQQLPQKQFPQPQQIPQQQQIPQQPQQFPQQQFPQQQQFPQQQEFPQQQFPQQQFHQQQLPQQQFPQQQFPQQQFPQQQQFPQQQQLTQQQFPRPQQSPEQQQFPQQQFPQQPPQQFPQQQFPIPYPPQQSEEPSPYQQYPQQQPSGSDVISISGL

SEQ ID NO: 1400 - protein, 298 aa, Triticum aestivum (Wheat)
MKTLLILTILAMAITIGTANMQVDPSSQVQWPQQQPVPQPHQPFSQQPQQTFPQPQQTFPHQPQQQFPQPQQPQQQFLQPQQPFPQQPQQPYPQQPQQPFPQTQQPQQLFPQSQQPQQQFSQPQQQFPQPQQPQQSFPQQQPPFIQPSLQQQVNPCKNFLLQQCKPVSLVSSLWSMIWPQSDCQVMRQQCCQQLAQIPQQLQCAAIHTIIHSIIMQQEQQEQQQGMHILLPLYQQQQVGQGTLVQGQGIIQPQQPAQLEAIRSLVLQTLPTMCNVYVPPECSIIKAPFSSVVAGIGGQ

SEQ ID NO: 1401 - protein, 281 aa, Triticum aestivum (Wheat)
VRVPVPQLQPQNPSQQQPQEQVPLVQQQQFLGQQQQHFPGQQQPFPPQQPYPQPQPFLPQLPYPQPQPFPPQQSYPQPQPQYPQPQQPISQQQAQLQQQQQQQQQQILQQILQQQLIPCRDVVLQQPNIAHASSQVSQQSYQLLQQLCCQQLWQTPEQSRCQAIHNVIHAIILHHQQQQQQQQQQQQQQQQQQQQQQQQQQQQPSSQVSYQQPQQQYPSGQGSFQPSQQNPQAQGFVQPQQLPQFEEIRNLALQTLPAMCNVYIPPYCSTTIAPFGIFSTN

SEQ ID NO: 1402 - protein, 125 aa, Triticum aestivum (Wheat)
MAASAATATAAAVGAGEVISVHSLEQWTMQIEEANAAKKLVVIDFTASWCGPCRIMAPIFADLAKKFPAAVFLKVDVDELKSIAEQFSVEAMPTFLFMKEGDVKDRVVGAIKEELTNKVGLHAAQ

SEQ ID NO: 1403 - protein, 848 aa, Triticum aestivum (Wheat)
MAKRLVLFVAVVVALVALTVAEGEASEQLQCERELQELQERELKACQQVMDQQLRDISPECHPVVVSPVAGQYEQQIVVPPKGGSFYPGETTPPQQLQQRIFWGIPALLKRYYPSVTCPQQVSYYPGQASPQRPGQGQQPGQGQQGYYPTSPQQPGQWQQPEQGQPRYYPTSPQQSGQLQQPAQGQQPGQGQQGQQPGQGQPGYYPTSSQLQPGQLQQPAQGQQGQQPGQAQQGQQPGQGQQPGQGQQGQQPGQGQQPGQGQQGQQLGQGQQGYYPTSLQQSGQGQPGYYPTSLQQLGQGQSGYYPTSPQQPGQGQQPGQLQQPAQGQQPGQGQQGQQPGQGQQGQQPGQGQQPGQGQPGYYPTSPQQSGQGQPGYYPTSSQQPTQSQQPGQGQQGQQVGQGQQAQQPGQGQQPGQGQPGYYPTSPQQSGQGQPGYYLTSPQQSGQGQQPGQLQQSAQGQKGQQPGQGQQPGQGQQGQQPGQGQQGQQPGQGQPGYYPTSPQQSGQGQQPGQWQQPGQGQPGYYPTSPLQPGQGQPGYDPTSPQQPGQGQQPGQLQQPAQGQQGQQLAQGQQGQQPAQVQQGQRPAQGQQGQQPGQGQQGQQLGQGQQGQQPGQGQQGQQPAQGQQGQQPGQGQQGQQPGQGQQGQQPGQGQQPGQGQPWYYPTSPQESGQGQQPGQWQQPGQGQPGYYLTSPLQLGQGQQGYYPTSLQQPGQGQQPGQWQQSGQGQHWYYPTSPQLSGQGQRPGQWLQPGQGQQGYYPTSPQQPGQGQQLGQWLQPGQGQQGYYPTSLQQTGQGQQSGQGQQGYYSSYHVSVEHQAASLKVAKAQQLAAQLPAMCRLEGGDALSASQ

SEQ ID NO: 1404 - protein, 795 aa, Triticum aestivum (Wheat)
MAKRLVLFAAVVVALVALTAAEGEASGQLQCEHELEACQQVVDQQLRDVSPGCRPITVSPGTRQYEQQPVVPSKAGSFYPSETTPSQQLQQMIFWGIPALLRRYYPSVTSSQQGSYYPGQASPQQSGQGQQPGQEQQPGQGQQDQQPGQRQQGYYPTSPQQPGQGQQLGQGQPGYYPTSQQPGQKQQAGQGQQSGQGQQGYYPTSPQQSGQGQQPGQGQPGYYPTSPQQSGQWQQPGQGQQPGQGQQSGQGQQGQQPGQGQRPGQGQQGYYPISPQQPGQGQQSGQGQPGYYPTSLRQPGQWQQPGQGQQPGQGQQGQQPGQGQQSGQGQQGYYPTSLQQPGQGQQLGQGQPGYYPTSQQSEQGQQPGQGKQPGQGQQGYYPTSPQQSGQGQQLGQGQPGYYPTSPQQSGQGQQSGQGQQGYYPTSPQQSGQGQQPGQGQSGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPISPQQSGQGQQPGQGQQGYYPTSPQQSGQGQQPGHEQQPGQWLQPGQGQQGYYPTSSQQSGQGHQSGQGQQGYYPTSLWQPGQGQQPGQGQQGYASPYHVSAEYQAARLKVAKAQQLAAQLPAMCRLEGSDALSTRQ

SEQ ID NO: 1405 - protein, 203 aa, Triticum aestivum (Wheat)
GDVATGRGSEKVHVAIYYESLCPYSVRFVANHLFKAYRDGLLDAANLTLVPYGNAVVRNDGTISCQHGPEECLLNTVEACAIDAWPDVKVHLGFIYCVSDLVLKNKHREWESCFQKQGLDPKPVTECYKGERGHNLSLEYGRQTAELVPPHQFVPWVVVDGKPLYNDYGNFKAYICKAYKGYPLLEACRSLGLEAHDDVYGRL

SEQ ID NO: 1406 - protein, 119 aa, Triticum aestivum (Wheat)
CYPGQAFQVPALPACRPLLRLQCNGSQVPEAVLRDCCQQLAHISEWCRCGALYSMLDSMYKEHGAQEGQAGTGAFPRCRREVVKLTAASITAVCRLPIVVDASGDGAYVCKDVAAYPDA

SEQ ID NO: 1407 - protein, 120 aa, Triticum aestivum (Wheat)
TGPYCYAGMGLPINPLEGCREYVAQQTCGISISGSAVSTEPGNTPRDRCCKELYDASQHCRCEAVRYFIGRRSDPNSSVLKDLPGCPREPQRDFAKVLVTPGHCNVMTVHNAPYCLGLDI

SEQ ID NO: 1408 - protein, 120 aa, Triticum aestivum (Wheat)
TGPYCYPGMGLPSNPLEGCREYVAQQTCGVGIVGSPVSTEPGNTPRDRCCKELYDASQHCWCEAVRYFIGRTSDPNSGVLKDLPGCPREPQRDSAKVLVTPGHCNVMTVHNTPYCLGLDI

SEQ ID NO: 1409 - protein, 168 aa, Triticum aestivum (Wheat)
MACKSSCSLLLLAAVLLSVLAAASASGSCVPGVAFRTNLLPHCRDYVLQQTCGTFTPGSKLPEWMTSASIYSPGKPYLAKLYCCQELAEISQQCRCEALRYFIALPVPSQPVDPRSGNVGESGLIDLPGCPREMQWDFVRLLVAPGQCNLATIHNVRYCPAVEQPLWI

SEQ ID NO: 1410 - protein, 253 aa, Triticum aestivum (Wheat)
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 1411 - protein, 218 aa, Triticum aestivum (Wheat)
MPGLTIGDTVPNLELDSTHGKIRIHDYVGNGYVILFSHPGDFTPVCTTELAAMANYAKEFEKRGVKLLGISCDDVQSHKEWTKDIEAYKPGSKVTYPIMADPDRSAIKQLNMVDPDEKDAEGQLPSRTLHIVGPDKKVKLSFLYPSCTGRNMDEVVRAVDSLLTAAKHKVATPANWNPGECVVIAPGVSDDEAKKMFPQGFETADLPSKKGYLRFTKV

SEQ ID NO: 1412 - protein, 398 aa, Triticum aestivum (Wheat)
MATTLATDVRLSIAHQTRFGFRLASTISSNPESTANNVAFSPVSLHVALSLITAGAGGATRDQLVATLGEGEAERLHALAEQVVQFVLADASYADSPRVTFANGVFVDASLPLKPSFQELAVCKYKAEAQSVDFQTKAAEVTAQVNSWVEKVTTGLIKDILPAGSISNTTRLVLGNALYFKGAWTDQFDSRVTKSDYFYLLDGSSIQTPFMYSSEEQYISSSDGLKVLKLPYKQGGDKRQFSMYILLPEAPSGIWSLAEKLSAEPELLERHIPRQKVALRQFKLPKFKISFGIEASDLLKHLGLQLPFSDEADLSEMVDSPMPQGLRISSVFHKTFVEVNETGTEAAAATIAKAVLLSASPPSDMDFIADHPFLFLIREDTSGVVLFIGHVVNPLRSL

SEQ ID NO: 1413 - protein, 337 aa, Triticum aestivum (Wheat)
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 1414 - protein, 112 aa, Triticum aestivum (Wheat)
MEHQGHGAGEKKGVVESITEKLPGGHGDHQQATGGTYGQQGHAGVTGENIKEKLPGGHGDHQQTTGMTGSETHATTATTDGNYGKSGHTGTDGTGENKSIMDKIKDKLPGQH

SEQ ID NO: 1415 - protein, 369 aa, Triticum aestivum (Wheat)
MKTFLIFALLAIVATSAIAQMENSHIPGLERPSQQQPLPPQQTLSHHQQQQPIQQQPQPFSQQQPCSQQQQQPLSQQQQPPFSQQQPPFSQQQQQPLSQQQQPPFSQQQPPFSQQQQPPFSQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPFGVGTGVGSY

SEQ ID NO: 1416 - protein, 137 aa, Triticum aestivum (Wheat)
MGSKGFKGVIVCLLILGLVLEQLQVEGKSCCRSTLGRNCYNLCRARGAQKLCAGVCRCKISSGLSCPKGFPKLALESNSDEPDTIEYCNLGCRSSVCDYMVNAAADDEEMKLYVENCADACVSFCNGDAGLPSLDAY

SEQ ID NO: 1417 - protein, 84 aa, Triticum aestivum (Wheat)
MSPVVKKPEGRNTDTSDHHNQKTEWPELVGKSVEEAKKVILQDKSEAQIVVLPVGTIVTMEYRIDRVRLFVDSLDKIAQVPRVG

SEQ ID NO: 1418 - protein, 143 aa, Triticum aestivum (Wheat)
MASKSNYNLLFTALLVFIFAAVAAVGNEDCTPWTSTLITPLPSCRNYVEEQACRIEMPGPPYLAKQECCEQLANIPQQCRCQALRYFMGPKSRPDQSGLMELPGCPREVQMNFVPILVTPGYCNLTTVHNTPYCLGMEESQWS

SEQ ID NO: 1419 - protein, 60 aa, Triticum aestivum (Wheat)
EMGDGQLCVICLRKRRRAAFVPCGHLVCCCNCAKRVELMDEPLCPVCRQDIQYMLRVYDS

SEQ ID NO: 1420 - protein, 76 aa, Triticum aestivum (Wheat)
EFTNTCMECLVCDVHVACGDFASNDVIDPAKFRRLGINDCLVNDGKSIEPSFPVSFQYGNSFPYPMTVASASCDCN

SEQ ID NO: 1421 - protein, 108 aa, Triticum aestivum (Wheat)
MTLVASSSLDPVWVEVLGDPLLRRLLLRFIFCRATLSLFKASNDKAECLPSCVPPLPESVGGESMLSQCCVMRVASFLGAADQFSFAEVTTWPDIDEPTSSGGVDKEL

SEQ ID NO: 1422 - protein, 107 aa, Triticum aestivum (Wheat)
MAKLMCLCFIILTIAVVVSADECEGDRQEMIKQCAKYQQWPANPKVNPSDACCAVWQKANIPCLCAGVTKEKEKIWCMEKVAYVANFCKKPFPHGYKCGSYTFPPLA

SEQ ID NO: 1423 - protein, 89 aa, Triticum aestivum (Wheat)
MGKRKAAAKPPPRKGMDKLDTVFSCPFCNHGSSVECRIDLKNLIGEANCQICQESFSTTANALTEAIDVYSEWIDECERVNTVEGDDGA

SEQ ID NO: 1424 - protein, 269 aa, Zea mays (Maize)
MGSLANNIMVVGAVLAALVVGGSCGPPKVPPGPNITTNYNGKWLTARATWYGQPNGAGAPDNGGACGIKNVNLPPYSGMTACGNVPIFKDGKGCGSCYEVRCKEKPECSGNPVTVFITDMNYEPIAPYHFDLSGKAFGSLAKPGLNDKLRHCGIMDVEFRRVRCKYPAGQKIVFHIEKGCNPNYVAVLVKFVADDGDIVLMEIQDKLSAEWKPMKLSWGAIWRMDTAKALKGPFSIRLTSESGKKVIAKDIIPANWRPDAVYTSNVQFY

SEQ ID NO: 1425 - protein, 280 aa, Zea mays (Maize)
MANAPRILALGLLALLCAAAGPAAAQNCGCQPNFCCSKFGYCGTTDAYCGDGCQSGPCRSGGGGGGGGGGGGGGSGGANVANVVTDAFFNGIKNQAGSGCEGKNFYTRSAFLSAVNAYPGFAHGGTEVEGKREIAAFFAHVTHETGHFCYISEINKSNAYCDASNRQWPCAAGQKYYGRGPLQISWNYNYGPAGRDIGFNGLADPNRVAQDAVIAFKTALWFWMNNVHGVMPQGFGATIRAINGALECNGNNPAQMNARVGYYKQYCQQLRVDPGPNLIC

SEQ ID NO: 1426 - protein, 131 aa, Zea mays (Maize)
MSWQTYVDEHLMCEIEGHHLTSAAIVGHDGATWAQSTAFPEFKPEEMAAIMKDFDEPGHLAPTGLILGGTKYMVIQGEPGAVIRGKKGSGGITVKKTGQSLIIGIYDEPMTPGQCNLVVERLGDYLLEQGM

SEQ ID NO: 1427 - protein, 131 aa, Zea mays (Maize)
MSWQAYVDEHLMCEIEGHHLAAAAIVGHDGAAWAQSTAFPEFKTEDMANIMKDFDEPGHLAPTGLFLGPTKYMVIQGEPGAVIRGKKGSGGITVKKTGQALVVGIYDEPMTPGQCNMVVERLGDYLLEQGM

SEQ ID NO: 1428 - protein, 131 aa, Zea mays (Maize)
MSWQTYVDEHLMCEIEGHHLSSAAIVGHDGAVWAQSTAFPQFKPEEMTNIIKDFDEPGFLAPIGLFLGPTKYMVIQGEPGAVIRGKKGSGGITVKKTGQALVIGIYDEPMTPGQCNMVVERLGDYLVEQGL

SEQ ID NO: 1429 - protein, 131 aa, Zea mays (Maize)
MSWQAYVDEHLMCEIEGQHLSAAAIVGHDGSVWAQSESFPELKPEEVAGIIKDFDEPGTLAPTGLFVGGTKYMVIQGEPGVVIRGKKGTGGITIKKTGMSLIIGVYDEPMTPGQCNMVVERLGDYLIEQGF

SEQ ID NO: 1430 - protein, 131 aa, Zea mays (Maize)
MSWQAYVDDHLLCDIEGQHLSAAAIVGHDGSVWAQSENFPELKPEEVAGMIKDFDEPGTLAPTGLFVGGTKYMVIQGEPGVVIRGKKGTGGITIKKTGMSLIIGIYDEPMTPGQCNMVVERLGDYLIEQGF

SEQ ID NO: 1431 - protein, 120 aa, Zea mays (Maize)
MARTQQLAVVATAVVALVLLAAATSEAAISCGQVASAIAPCISYARGQGSGPSAGCCSGVRSLNNAARTTADRRAACNCLKNAAAGVSGLNAGNAASIPSKCGVSIPYTISTSTDCSRVN

SEQ ID NO: 1432 - protein, 128 aa, Zea mays (Maize)
MARTQQLAVVATAVVALVLLAAATSEAAISCGQVASAIAPCISYARGQGSGPSAGCCSGVRSLNNAARTTADRRAACNCLKNAAAGVSGLNAGNAASIPSKCGVSIPYTISTSTDCSRYSRRMHASAD

SEQ ID NO: 1433 - protein, 128 aa, Zea mays (Maize)
MAASEAAAAAATPVAPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 1434 - protein, 150 aa, Acacia farnesiana (Vachellia farnesiana) (Needle bush)
DDVPKPPVSQFHVQGLVYCDTCRYPFITEASPIMEGATVKLECRNITAGTQTFKAEAVTDKVGQYSIPVDGDHEDDICEIELVKSPDNQCSEIPHDVYAKQSAKVSLTSNNGEASDVRSANALGFMRKEPLPECPEVLKEKLDMYDVKAN

SEQ ID NO: 1435 - protein, 133 aa, Acacia farnesiana (Vachellia farnesiana) (Needle bush)
MCWQTYVDDHLMCEIEGTNNHLSGAAILGVDGSVWAQSASFPQFKPDEIAAVVKDFDGPGTLAPTGLHLGGTKYMVIQGEPGRFIRGKKGPGGICVKKTGQALVFGIYDEPVTPGQCNMIVERLGDYLVEQGM

SEQ ID NO: 1436 - protein, 34 aa, Actinidia chinensis (Gold Kiwi fruit)
ISSCNGPCRDLNDCDGQLICGTTHSHQPGGCKPS

SEQ ID NO: 1437 - protein, 213 aa, Actinidia chinensis (Gold Kiwi fruit)
MAQLSLLLLSLFLTLISLPPPGASISSCNGPCRDLNDCDGQLICIKGKCNDDPEVGTHICRGTTPSPQPGGCKPSGTLTCQGKSHPTYDCSPPVTSSTPAKLTNNDFSEGGDGGGPSECDESYHSNNERIVALSTGWYNGGSRCGKMIRITASNGKSVSAKVVDECDSRHGCDKEHAGQPPCRNNIVDGSNAVWSALGLNKNVGVVDITWSMA

SEQ ID NO: 1438 - protein, 159 aa, Actinidia chinensis (Gold Kiwi fruit)
MGVVTYDMEIPSKVPPVKLYKAFILDGDTLVPKVLPHAIKCVKILEGDGCAGTIKEVTFGEGSHHKCVKQRVDAIDKDNLTYSYTIIEGDVLAEKFESISYHIKIVACPDGGSICKNRSIYTTKGDCKVSEEEIKLGKEKAAEIFKALEAYLLANPDYC

SEQ ID NO: 1439 - protein, 15 aa, Actinidia chinensis (Gold Kiwi fruit)
AVSCGQVDTALTPCL

SEQ ID NO: 1440 - protein, 380 aa, Actinidia deliciosa (Green Kiwi fruit)
MGLPKSFVSMSLLFFSTLLILSLAFNAKNLTQRTNDEVKAMYESWLIKYGKSYNSLGEWERRFEIFKETLRFIDEHNADTNRSYKVGLNQFADLTDEEFRSTYLRFTSGSNKTKVSNRYEPRVGQVLPSYVDWRSAGAVVDIKSQGECGGCWAFSAIATVEGINKIVTGVLISLSEQELIDCGRTQNTRGCNGGYITDGFQFIINNGGINTEENYPYTAQDGECNVDLQNEKYVTIDTYENVPYNNEWALQTAVTYQPVSVALDAAGDAFKQYSSGIFTGPCGTAVDHAVTIVGYGTEGGIDYWIVKNSWDTTWGEEGYMRILRNVGGAGTCGIATMPSYPVKYNNQNHPKPYSSLINPPAFSMSKDGPVGVDDGQRYSA

SEQ ID NO: 1441 - protein, 225 aa, Actinidia deliciosa (Green Kiwi fruit)
MSTFKSLSLSALLFIAFLFTCARGATFNIINNCPFTVWAAAVPGGGKRLDRGQNWIINPGAGTKGARVWPRTGCNFDGAGRGKCQTGDCNGLLQCQAFGQPPNTLAEYALNQFNNLDFFDISLVDGFNVAMEFSPTSGGCTRGIKCTADINGQCPNELRAPGGCNNPCTVFKTDQYCCNSGNCGLTNFSKFFKDRCPDAYSYPKDDQTSTFTCPAGTNYKVVFCP

SEQ ID NO: 1442 - protein, 36 aa, Actinidia deliciosa (Green Kiwi fruit)
  misc_feature (21)..(21): Xaa can be any naturally occurring amino acid
  misc_feature (35)..(35): Xaa can be any naturally occurring amino acid
FTDGLMKNGNFELAPKPEDMXGTVRVESLKAVKYXD

SEQ ID NO: 1443 - protein, 116 aa, Actinidia deliciosa (Green Kiwi fruit)
MVPKPLSLLLFLLLALSAAVVGGRKLVAAGGWRPIESLNSAEVQDVAQFAVSEHNKQANDELQYQSVVRGYTQVVAGTNYRLVIAAKDGAVVGNYEAVVWDKPWMHFRNLTSFRKV

SEQ ID NO: 1444 - protein, 189 aa, Actinidia deliciosa (Green Kiwi fruit)
ISSCNGPCRDLNDCDGQLICIKGKCNDDPQVGTHICRGTTHSHQPGGCKPSGTLTCRGKSYPTYDCSPPVTSSTPAKLTNNDFSEGGDDGGPSECDESYHNNNERIVALSTGWYNGGSRCGKMIRITASNGKSVSAKVVDECDSRHGCDKEHAGQPPCRNNIVDGSNAVWSALGLDKNVGVVDITWSMA

SEQ ID NO: 1445 - protein, 185 aa, Actinidia deliciosa (Green Kiwi fruit)
MAFSYCSSSLFVSLLLVILFISPLSQRPSVKAENHLISEICPKTRNPSLCLQALESDPRSASKDLKGLGQFSIDIAQASAKQTSKIIASLTNQATDPKLKGRYETCSENYADAIDSLGQAKQFLTSGDYNSLNIYASAAFDGAGTCEDSFEGPPNIPTQLHQADLKLEDLCDIVLVISNLLPGSK

SEQ ID NO: 1446 - protein, 321 aa, Actinidia deliciosa (Green Kiwi fruit)
TAVTDIVPDVVVAKDGSGNFTTVGAAVAAAKDSSTARFVIYIKEGAYFEYVDVDKKKTNLMFIGDGIGKTWIKGNRSVVDGWTTFRSSTVAVVGTGFIARGISFENYAGPSKHQAVALRSGADFSAFYQCSFVGYQDTLYVHSLRQFYSECDVYGTIDFIFGNAAAVLQKCNLYARKPNENQKNIFTAQGRDDPNQNTGISILNCKVAAAADLIPVLSSFKTYLGRPWKEYSRTVFLLSQMESLIDPAGWLEWSGDFALTTLYYREYKNTGPGSNTTARVTWPGYAVTTNETEVIQFTVGNFIQGSQWLTSYNIPVYLNLT

SEQ ID NO: 1447 - protein, 157 aa, Actinidia deliciosa (Green Kiwi fruit)
MGAITYDMEIPSSISAEKMFKAFVLDGDTIIPKALPHAITGVQTLEGDGGVGTIKLTTFGEGSVHKSVKHRIDGLDKENFTYSYSIIEGGALDVFESISYHIKIVATPDGGCICKNRSIYTPKCDAQVSEEEIKAGKERASGIFKKVEAYLLANPDC

SEQ ID NO: 1448 - protein, 92 aa, Actinidia deliciosa (Green Kiwi fruit)
AVSCGQVDTALTPCLTYLTKGGTPSTQCCSGVRSLKSMTGTKVPDRQAACNCLKQAAARYQGIKDAAAALSQKCGVQLSVPISRSTDCSKIS

SEQ ID NO: 1449 - protein, 92 aa, Actinidia deliciosa (Green Kiwi fruit)
TVSCGQVDTALTPCLTYLTKGGTPSTQCCSGVRSLKSMTGTKVPDRQAACNCLKQAAARYQGIKDAAAALSQKCGVQLSVPISRSTDCSKIS

SEQ ID NO: 1450 - protein, 150 aa, Actinidia deliciosa (Green Kiwi fruit)
MDLSGKMVKQVEILSDGIVFYEIFRYRLYLISEMSPVNIQGVDLLEGNWGTVGSVIFFKYTIDGKEKTAKDIVEAIDEETKSVTFKIVEGDLMELYKTFIIIVQVDTKGEHNSVTWTFHYEKLKEDVEEPNTLMNFCIEITKDIETYHLK

SEQ ID NO: 1451 - protein, 13 aa, Actinidia deliciosa (Green Kiwi fruit)
NRQPSKYGLEETI

SEQ ID NO: 1452 - protein, 462 aa, Actinidia deliciosa (Green Kiwi fruit)
MARPSFLSLVSLSLLVLSHSSAANRQPSKYQQQQKGECQIQRLNAQEPQQRIQAEAGVTEFWDWTDDQFQCAGVAACRNMIQPRGLLLPSYTNAPTLIYILKGRGITGVMIPGCPETYQSSQQSREGDVSHRQFRDQHQKIRRFQQGDVIALPAGVAHWCYNDGDSDLVTVSVEDTGNRQNQLDNNPRRFFLAGNPQQQQKEMYAKRPQQQHSGNVFRGFDTEVLAETFGVDMEMARRLQGKDDYRGHIIQVERELKIVRPPRTREEQEQQERGERDNGMEETICTARLVENIDNPSRADIFNPRAGRLTSVNSFNLPILNYLRLSAEKGVLYRNALMPPHWKLNAHCVLYATRGEAQMQIVDQRGEAVFNDRIREGQLVVVPQNFVVMKQAGNQGFEWVAIKTNENAMFNTLAGRTSALRAMPVDVLANAYQISQSEARRLKMGREEAVLFEPRSEGRDVD

SEQ ID NO: 1453 - protein, 160 aa, Alnus glutinosa (Alder)
MGVFNYEAETPSVIPAARLFKAFILDGDKLLPKVAPEAVSSVENIEGNGGPGTIKKITFPEGSPFKYVKERVDEVDRVNFKYSFSVIEGGAVGDALEKVCNEIKIVAAPDGGSILKISNKFHTKGDHEINAEQIKIEKEKAVGLLKAVESYLLAHSDAYN

SEQ ID NO: 1454 - protein, 85 aa, Alnus glutinosa (Alder)
MADDHPQDQAEHERIFKCFDANGDGKISASELGDALKTLGSVTPDEVKHMMAEIDTDGDGFISFQEFTNFARANRGLVKDVAKIF

SEQ ID NO: 1455 - protein, 168 aa, Amaranthus retroflexus (Redroot pigweed)
MAKCQAVFLLVGALCVLSLDDVAKAPVSQFHIQGLVYCDTCRIQFMTRISTIMEGATVKLECRNITAGTQTFKAEAVTDKVGQYSIPVNGDFEDDICEIELVKSPNSECSEVSHDVYAKQSAKVSLTSNNGEASDIRSANALGFMRKEPLEECPEVLKELDLYDVKAN

SEQ ID NO: 1456 - protein, 133 aa, Amaranthus retroflexus (Redroot pigweed)
MSWQAYVDDHLMCEIEGTTNHLTGAAILGLDGSVWAQSADFPQFKPDEIAAIVEDFDEPGTLAPTGLHLGGTKYMVIQGEPGAVIRGKKGAGGICVKKTGQALVMGIYDEPVTPGQCNMIVERLGDYLIEQGY

SEQ ID NO: 1457 - protein, 396 aa, Ambrosia artemisiifolia (Short ragweed)
MGIKHCCYILYFTLALVTLLQPVRSAEDLQEILPVNETRRLTTSGAYNIIDGCWRGKADWAENRKALADCAQGFGKGTVGGKDGDIYTVTSELDDDVANPKEGTLRFGAAQNRPLWIIFERDMVIRLDKEMVVNSDKTIDGRGAKVEIINAGFTLNGVKNVIIHNINMHDVKVNPGGLIKSNDGPAAPRAGSDGDAISISGSSQIWIDHCSLSKSVDGLVDAKLGTTRLTVSNSLFTQHQFVLLFGAGDENIEDRGMLATVAFNTFTDNVDQRMPRCRHGFFQVVNNNYDKWGSYAIGGSASPTILSQGNRFCAPDERSKKNVLGRHGEAAAESMKWNWRTNKDVLENGAIFVASGVDPVLTPEQSAGMIPAEPGESALSLTSSAGVLSCQPGAPC

SEQ ID NO: 1458 - protein, 398 aa, Ambrosia artemisiifolia (Short ragweed)
MGIKHCCYILYFTLALVTLLQPVRSAEDVEEFLPSANETRRSLKACEAHNIIDKCWRCKADWANNRQALADCAQGFAKGTYGGKHGDVYTVTSDKDDDVANPKEGTLRFAAAQNRPLWIIFKRNMVIHLNQELVVNSDKTIDGRGVKVNIVNAGLTLMNVKNIIIHNINIHDIKVCPGGMIKSNDGPPILRQQSDGDAINVAGSSQIWIDHCSLSKASDGLLDITLGSSHVTVSNCKFTQHQFVLLLGADDTHYQDKGMLATVAFNMFTDHVDQRMPRCRFGFFQVVNNNYDRWGTYAIGGSSAPTILSQGNRFFAPDDIIKKNVLARTGTGNAESMSWNWRTDRDLLENGAIFLPSGSDPVLTPEQKAGMIPAEPGEAVLRLTSSAGVLSCHQGAPC

SEQ ID NO: 1459 - protein, 398 aa, Ambrosia artemisiifolia (Short ragweed)
MGIKHCCYILYFTLALVTLLQPVRSAEDVEEFLPSANETRRSLKACEAHNIIDKCWRCKADWANNRQALADCAQGFAKGTYGGKHGDVYTVTSDKDDDVANPKEGTLRFAAAQNRPLWIIFKRNMVIHLNQELVVNSDKTIDGRGVKVNIVNAGLTLMNVKNIIIHNINIHDIKVCPGGMIKSNDGPPILRQQSDGDAINVAGSSQIWIDHCSLSKASDGLLDITLGSSHVTVSNCKFTQHQFVLLLGADDTHYQDKGMLATVAFNMFTDHVDQRMPRCRFGFFQVVNNNYDRWGTYAIGGSSAPTILSQGNRFFAPDDIIKKNVLARTGTGNAESMSWNWRTDKDLLENGAIFLPSGSDPVLTPEQKAGMIPAEPGEAVLRLTSSAGVLSCHQGAPC

SEQ ID NO: 1460 - protein, 397 aa, Ambrosia artemisiifolia (Short ragweed)
MGIKQCCYILYFTLALVALLQPVRSAEGVGEILPSVNETRSLQACEALNIIDKCWRGKADWENNRQALADCAQGFAKGTYGGKWGDVYTVTSNLDDDVANPKEGTLRFAAAQNRPLWIIFKNDMVINLNQELVVNSDKTIDGRGVKVEIINGGLTLMNVKNIIIHNINIHDVKVLPGGMIKSNDGPPILRQASDGDTINVAGSSQIWIDHCSLSKSFDGLVDVTLGSTHVTISNCKFTQQSKAILLGADDTHVQDKGMLATVAFNMFTDNVDQRMPRCRFGFFQVVNNNYDRWGTYAIGGSSAPTILCQGNRFLAPDDQIKKNVLARTGTGAAESMAWNWRSDKDLLENGAIFVTSGSDPVLTPVQSAGMIPAEPGEAAIKLTSSAGVFSCHPGAPC

SEQ ID NO: 1461 - protein, 397 aa, Ambrosia artemisiifolia (Short ragweed)
MGIKQCCYILYFTLALVALLQPVRSAEGVGEILPSVNETRSLQACEALNIIDKCWRGKADWENNRQALADCAQGFAKGTYGGKWGDVYTVTSNLDDDVANPKEGTLRFAAAQNRPLWIIFKNDMVINLNQELVVNSDKTIDGRGVKVEIINGGLTLMNVKNIIIHNINIHDVKVLPGGMIKSNDGPPILRQASDGDTINVAGSSQIWIDHCSLSKSFDGLVDVTLGSTHVTISNCKFTQQSKAILLGADDTHVQDKGMLATVAFNMFTDNVDQRMPRCRFGFFQVVNNNYDRWGTYAIGGSSAPTILCQGNRFLAPDDQIKKNVLARTGTGAAESMAWNWRSDKDLLENGAIFVTSGSDPVLTPVQSAGMIPAEPGEAAIKLTSSAGVLSCRPGAPC

SEQ ID NO: 1462 - protein, 397 aa, Ambrosia artemisiifolia (Short ragweed)
MGIKQCCYILYFTLALVALLQPVRSAEGVGEILPSVNETRSLQACEAYNIIDKCWRGKADWENNRQALADCAQGFAKGTYGGKWGDVYTVTSNLDDDVANPKEGTLRFAAAQNRPLWIIFKNDMVINLNQELVVNSDKTIDGRGVKVEIINGGLTLMNVKNIIIHNINIHDVKVLPGGMIKSNDGPPILRQASDGDTINVAGSSQIWIDHCSLSKSFDGLVDVTLGSTHVTISNCKFTQQSKAILLGADDTHVQDKGMLATVAFNMFTDNVDQRMPRCRFGFFQVVNNNYDRWGTYAIGGSSAPTILCQGNRFLAPDDQIKKNVLARTGTGAAESMAWNWRSDKDLLENGAIFVTSGSDPVLTPVQSAGMIPAEPGEAAIKLTSSAGVLSCRPGAPC

SEQ ID NO: 1463 - protein, 392 aa, Ambrosia artemisiifolia (Short ragweed)
MGIKHCCYILYFTLALVTLLQPVRSAEDLQQILPSANETRSLTTCGTYNIIDGCWRGKADWAENRKALADCAQGFAKGTIGGKDGDIYTVTSELDDDVANPKEGTLRFGAAQNRPLWIIFARDMVIRLDRELAINNDKTIDGRGAKVEIINAGFAIYNVKNIIIHNIIMHDIVVNPGGLIKSHDGPPVPRKGSDGDAIGISGGSQIWIDHCSLSKAVDGLIDAKHGSTHFTVSNCLFTQHQYLLLFWDFDERGMLCTVAFNKFTDNVDQRMPNLRHGFVQVVNNNYERWGSYALGGSAGPTILSQGNRFLASDIKKEVVGRYGESAMSESINWNWRSYMDVFENGAIFVPSGVDPVLTPEQNAGMIPAEPGEAVLRLTSSAGVLSCQPGAPC

SEQ ID NO: 1464 - protein, 387 aa, Ambrosia artemisiifolia (Short ragweed)
CCYILYFTLALVILLQPVRSAEDLQQILPSVNETRSLTTCGTYNIIDGCWRGKADWAENRKALADCAQGFAKGTIGGKDGDIYTVTSELDDDVANPKEGTLRFGAAQNRPLWIIFARDMVIRLDRELAINNDKTIDGRGAKVEIINAGFAIYNVKNIIIHNIIMHDIVVNPGGLIKCNDGPPAPRKGSDGDAIGISGGSQIWIDHCSLSKAVDGLIDAKHGSTHFTVSNCLFTQHQYLLLFWDFDERGMLCTVAFNKFTDNVDQRMPNLRHGFVQVVNNNYERWGSYALGGSAGPTILSQGNRFLASDIKKEVVGRYGESAMSESINWNWRSYMDVFENGAIFVPSGVDPVLTPEQNAGMIPAEPGEAVLRLTSSAGVLSCQPGTPC

SEQ ID NO: 1465 - protein, 397 aa, Ambrosia artemisiifolia (Short ragweed)
MGIKHCCYILYFTLALVTLVQAGRLGEEVDILPSPNDTRRSLQGCEAHNIIDKCWRCKPDWAENRQALGNCAQGFGKATHGGKWGDIYMVTSDQDDDVVNPKEGTLRFGATQDRPLWIIFQRDMIIYLQQEMVVTSDKTIDGRGAKVELVYGGITLMNVKNVIIHNIDIHDVRVLPGGRIKSNGGPAIPRHQSDGDAIHVTGSSDIWIDHCTLSKSFDGLVDVNWGSTGVTISNCKFTHHEKAVLLGASDTHFQDLKMHVTLAYNIFTNTVHERMPRCRFGFFQIVNNFYDRWDKYAIGGSSNPTILSQGNKFVAPDFIYKKNVCLRTGAQEPEWMTWNWRTQNDVLENGAIFVASGSDPVLTAEQNAGMMQAEPGDMVPQLTMNAGVLTCSPGAPC

SEQ ID NO: 1466 - protein, 397 aa, Ambrosia artemisiifolia (Short ragweed)
MGIKHCCYILYFTLALVTLVQAGRLGEEVDILPSPNDTRRSLQGCEAHNIIDKCWRCKPDWAENRQALGDCAQGFGKATHGGKWGDIYMVTSDQDDDVVNPKEGTLRFGATQDRPLWIIFQRDMIIYLQQEMVVTSDTTIDGRGAKVELVYGGITLMNVKNVIIHNIDIHDVRVLPGGRIKSNGGPAIPRHQSDGDAIHVTGSSDVWIDHCTLSKSFDGLVDVNWGSTGVTISNCKFTHHEKAVLLGASDTHFQDLKMHVTLAYNIFTNTVHERMPRCRFGFFQIVNNFYDRWDKYAIGGSSNPTILSQGNKFVAPDFIYKKNVCLRTGAQEPEWMTWNWRTQNDVLENGAIFVASGSDPVLTAEQNAGMMQAEPGDMVPQLTMNAGVLTCSPGAPC

SEQ ID NO: 1467 - protein, 101 aa, Ambrosia artemisiifolia (Short ragweed)
GKVYLVGGPELGGWKLQSDPRAYALWSARQQFKTTDVLWFNFTTGEDSVAEVWREEAYHACDIKDPIRLEPGGPDRFTLLTPGSHFICTKDQKFVACVPGR

SEQ ID NO: 1468 - protein, 164 aa, Ambrosia artemisiifolia (Short ragweed)
MAAGLLVFVLAISEIASVKGKLCEKPSVTWSGKCKVKQTDKCDKRCIEWEGAKHGACHKRDSKATCFCYFDCDPTKNPGPPPGAPKGKAPAPSPPSGGGAPPPSGGEGGDGPPPPEGGEGGGDGGGEGGGEGGGDGGGEGGGEGGGDGGGDGGGEGGGEGGGER

SEQ ID NO: 1469 - protein, 45 aa, Ambrosia artemisiifolia (Short ragweed)
LVPCAWAGNVCGEKRAYCCSDPGRYCPWQVVCYESSEICSKKCGK

SEQ ID NO: 1470 - protein, 118 aa, Ambrosia artemisiifolia (Short ragweed)
MDCIRILWSVAVGLLLVSWRPTMFAASPTCDTVQNILAPCAGFLTGQEPSKACCTGVNNLNNSRKTKADRVAVCNCIKELTKSIAYDPKRMPLLSTKCGVKPDFPAVDKNLDCSKLPV

SEQ ID NO: 1471 - protein, 133 aa, Ambrosia artemisiifolia (Short ragweed)
MSWQTYVDEHLMCDIEGTGQHLASAAIFGTDGNVWAKSSSFPEFKPDEINAIIKEFSEPGALAPTGLFLAGAKYMVIQGEPGAVIRGKKGAGGICIKKTGQAMVFGIYEEPVNPGQCNMVVERLGDYLVDQGM

SEQ ID NO: 1472 - protein, 133 aa, Ambrosia artemisiifolia (Short ragweed)
MSWQTYVDEHLMCDIDGSGHHLSSAAIFGTDGAVWAKSGSFPEFKPDEINAIIKEFDAAGTLAPTGLFLAGAKYMVIQGEPGAVIRGKKGAGGICIKKTGQAMVFGIYEEPVAPGQCNMVVERLGDYLVDQGM

SEQ ID NO: 1473 - protein, 83 aa, Ambrosia artemisiifolia (Short ragweed)
MAEEEDKAERDRIFGAFDANKDGKISSTELGESLKNLGSVSPEEVQTMMEELDTDGDGFISYEEFTDFYNANRGLMKDVGKIF

SEQ ID NO: 1474 - protein, 83 aa, Ambrosia artemisiifolia (Short ragweed)
MAEDEDKAERDRIFGAFDANKDGKISSNELGEALKNLGSVSPEEVQTMMEELDTDGDGFISYEEFTDFYNANRGLMKDVGKIF

SEQ ID NO: 1475 - protein, 160 aa, Ambrosia artemisiifolia (Short ragweed)
MAPENNKHSIFPTDKEEVTKIFNRFDTNGDGQISEDELFAILKSLGSDTSPDEVKRVMAEIDADGDGFISLDEFILFCKGIESEGDEINDLKEAFKFYDQNNNGVISANELHQILGRLGENYSVESCADMIKSVDSDGDGFVDFEEFRKMMSRKGGDGAM

SEQ ID NO: 1476 - protein, 386 aa, Ambrosia artemisiifolia (Short ragweed)
MEINKLVCFSFSLVLILGLVESFHYHERELESEEGFMGMYDRWREQHNIEMRSPERFNVFKYNVRRIHESNKMDKPYKLKVNEFADMTNLEFVNTYANSKISHFQALRGSAPGSIDTDPNKDFIYANVTKIPDKVDWREKNAVTDVKGQGGCGSCWAFAAVVALEGINAIRTGKLVKFSEQQLVDCDMTNAGCDGGLMEPAFTYVIKHGGIAPEASYPYVGKRETCDKAKIKDVLKIDGRQNVPGLDEEALRKAVAHQPVATGIQLSGHGLQFYSEGVYTGDCGTEPNHGVGIVGYGENEKGIKFWTVKNSWGPTWGEKGYIHLQRGARKEGLCGVAMHSSFPIMNDPNPPKDDPNGPKDDPDAPKDPKFKTTQRLQGIRTKLLEL

SEQ ID NO: 1477 - protein, 431 aa, Ambrosia artemisiifolia (Short ragweed)
MLFVDEIKVDITLSDGTLARAAVPSGASTGIYEALELRDGGSDYLGKGVSKAVANVNTIIGPALVGKDPTDQTGIDNFMVQQLDGTQNEWGWCKQKLGANAILAVPLAVCKAGASVLKTPLYKHIANLAGNKNLVLPVPAFNVINGGSHAGNKLAMQEFMILPIGASSFKEAMKMGVEVYHNLKSVIKKKYGQDATNVGDEGGFAPNIQENKEGLELLKTAIAKAGYTDKVVIGMDVAASEFYGEKDKTYDLNFKEENNDGKEKISGEQLKDLYKSFVSEYPIVSIEDPFDQDDWEHYAKMTAECGEQVQIVGDDLLVTNPTRVKKAIDEKTCNALLLKVNQIGSVTESIEAVRMSKHAGWGVMASHRSGETEDTFIADLSVGLATGQIKTGAPCRSERLAKYNQLLRIEEELGSEAVYAGANFRKPVEPY

SEQ ID NO: 1478 - protein, 445 aa, Ambrosia artemisiifolia (Short ragweed)
MATIKAVKARQIFDSRGNPTVEVDITLSDGTLARAAVPSGASTGIYEALELRDGGSDYLGKGVSKAVANVNTIIGPALVGKDPTDQTGIDNFMVQQLDGTQNEWGWCKQKLGANAILAVSLAVCKAGASVLKTPLYKHIANLAGNKNLVLPVPAFNVINGGSHAGNKLAMQEFMILPIGASSFKEAMKMGVEVYHNLKSVIKKKYGQDATNVGDEGGFAPNIQENKEGLELLKTAIAKAGYTDKVVIGMDVAASEFYGEKDKTYDLNFKEENNDGKEKISGEQLKDLYKSFVSEYPIVSIEDPFDQDDWEHYAKMTAECGEQVQIVGDDLLVTNPTRVKKAIDEKTCNALLLKVNQIGSVTESIEAVRMSKHAGWGVMASHRSGETEDTFIADLSVGLATGQIKTGAPCRSERLAKYNQLLRIEEELGSEAVYAGANFRKPVEPY

SEQ ID NO: 1479 - protein, 77 aa, Ambrosia psilostachya (Western ragweed)
MNNEKNVSFEFIGSTDEVDEIKLLPCAWAGNVCGEKRAYCCSDPGRYCPWQVVCYESSEICSQKCGKMRMNVTKNTI

SEQ ID NO: 1480 - protein, 77 aa, Ambrosia psilostachya (Western ragweed)
MNNEKNVSFEFIGSTNEVDEIKVMACYAAGSICGEKRGYCSSDPGRYCPWQVVCYESRKICAKNAAKMRMNVTKNTI

SEQ ID NO: 1481 - protein, 73 aa, Ambrosia trifida (Giant ragweed)
MKNIFMLTLFILIITSTIKAIGSTNEVDEIKQEDDGLCYEGTNCGKVGKYCCSPIGKYCVCYDSKAICNKNCT

SEQ ID NO: 1482 - protein, 538 aa, Anacardium occidentale (Cashew)
MGPPTKFSFSLFLVSVLVLCLGFALAKIDPELKQCKHQCKVQRQYDEQQKEQCVKECEKYYKEKKGREREHEEEEEEWGTGGVDEPSTHEPAEKHLSQCMRQCERQEGGQQKQLCRFRCQERYKKERGQHNYKREDDEDEDEDEAEEEDENPYVFEDEDFTTKVKTEQGKVVLLPKFTQKSKLLHALEKYRLAVLVANPQAFVVPSHMDADSIFFVSWGRGTITKILENKRESINVRQGDIVSISSGTPFYIANNDENEKLYLVQFLRPVNLPGHFEVFHGPGGENPESFYRAFSWEILEAALKTSKDTLEKLFEKQDQGTIMKASKEQIRAMSRRGEGPKIWPFTEESTGSFKLFKKDPSQSNKYGQLFEAERIDYPPLEKLDMVVSYANITKGGMSVPFYNSRATKIAIVVSGEGCVEIACPHLSSSKSSHPSYKKLRARIRKDTVFIVPAGHPFATVASGNENLEIVCFEVNAEGNIRYTLAGKKNIIKVMEKEAKELAFKMEGEEVDKVFGKQDEEFFFQGPEWRKEKEGRADE

SEQ ID NO: 1483 - protein, 536 aa, Anacardium occidentale (Cashew)
PPTKFSFSLFLVSVLVLCLGFALAKIDPELKQCKHQCKVQRQYDEQQKEQCVKECEKYYKEKKGREREHEEEEEEWGTGGVDEPSTHEPAEKHLSQCMRQCERQEGGQQKQLCRFRCQERYKKERGQHNYKREDDEDEDEDEAEEEDENPYVFEDEDFTTKVKTEQGKVVLLPKFTQKSKLLHALEKYRLAVLVANPQAFVVPSHMDADSIFFVSWGRGTITKILENKRESINVRQGDIVSISSGTPFYIANNDENEKLYLVQFLRPVNLPGHFEVFHGPGGENPESFYRAFSWEILEAALKTSKDTLEKLFEKQDQGTIMKASKEQVRAMSRRGEGPKIWPFTEESTGSFKLFKKDPSQSNKYGQLFEAERIDYPPLEKLDMVVSYANITKGGMSVPFYNSRATKIAIVVSGEGCVEIACPHLSSSKSSHPSYKKLRARIRKDTVFIVPAGHPFATVASGNENLEIVCFEVNAEGNIRYTLAGKKNIIKVMEKEAKELAFKMEGEEVDKVFGKQDEEFFFQGPEWRKEKEGRADE

SEQ ID NO: 1484 - protein, 457 aa, Anacardium occidentale (Cashew)
LSVCFLILFHGCLASRQEWQQQDECQIDRLDALEPDNRVEYEAGTVEAWDPNHEQFRCAGVALVRHTIQPNGLLLPQYSNAPQLIYVVQGEGMTGISYPGCPETYQAPQQGRQQGQSGRFQDRHQKIRRFRRGDIIAIPAGVAHWCYNEGNSPVVTVTLLDVSNSQNQLDRTPRKFHLAGNPKDVFQQQQQHQSRGRNLFSGFDTELLAEAFQVDERLIKQLKSEDNRGGIVKVKDDELRVIRPSRSQSERGSESEEESEDEKRRWGQRDNGIEETICTMRLKENINDPARADIYTPEVGRLTTLNSLNLPILKWLQLSVEKGVLYKNALVLPHWNLNSHSIIYGCKGKGQVQVVDNFGNRVFDGEVREGQMLVVPQNFAVVKRAREERFEWISFKTNDRAMTSPLAGRTSVLGGMPEEVLANAFQISREDARKIKFNNQQTTLTSGESSHHMRDDA

SEQ ID NO: 1485 - protein, 138 aa, Anacardium occidentale (Cashew)
MAKFLLLLSAFAVLLLVANASIYRAIVEVEEDSGREQSCQRQFEEQQRFRNCQRYVKQEVQRGGRYNQRQESLRECCQELQEVDRRCRCQNLEQMVRQLQQQEQIKGEEVRELYETASELPRICSISPSQGCQFQSSY

SEQ ID NO: 1486 - protein, 154 aa, Apium graveolens (Celery)
MGVQTHVLELTSSVSAEKIFQGFVIDVDTVLPKAAPGAYKSVEIKGDGGPGTLKIITLPDGGPITTMTLRIDGVNKEALTFDYSVIDGDILLGFIESIENHVVLVPTADGGSICKTTAIFHTKGDAVVPEENIKYANEQNTALFKALEAYLIAN

SEQ ID NO: 1487 - protein, 159 aa, Apium graveolens (Celery)
MGVQKTVVEAPSTVSAEKMYQGFLLDMDTVFPKVLPQLIKSVEILEGDGGVGTVKLVHLGEATEYTTMKQKVDVIDKAGLAYTYTTIGGDILVDVLESVVNEFVVVPTDGGCIVKNTTIYNTKGDAVLPEDKIKEATEKSALAFKAVEAYLLANLQFLA

SEQ ID NO: 1488 - protein, 118 aa, Apium graveolens (Celery)
MGVSKVAIAVAVMLMVVVINHPAVVEGLTCGQVTGKLGGCLGYLKGGGYPSPACCGGVKGLNSLAKTPADRKQACACLKTLAGSVKGINYGAASALPGKCGIRIPYPISPSTDCSRVN

SEQ ID NO: 1489 - protein, 264 aa, Apium graveolens (Celery) [sequence omitted]

SEQ ID NO: 1490 - protein, 134 aa, Apium graveolens (Celery)
MSWQAYVDDHLMCEVEGNPGQTLTAAAIIGHDGSVWAQSSTFPQIKPEEIAGIMKDFDEPGHLAPTGLYLGGAKYMVIQGEPNAVIRGKKGSGGVTIKKTGQALVFGVYDEPVTPGQCNVIVERLGDYLIDQGL

SEQ ID NO: 1491 - protein, 86 aa, Apium graveolens (Celery)
  misc_feature (51)..(51): Xaa can be any naturally occurring amino acid
LPNPSGFVTCLSSISKSVYTPAINLKAVIADPVAKTAVVQAGATLGEVYYXIIYARVLWVGNTTQKLEWIRSLHDYQSSFFPFFSA

SEQ ID NO: 1492 - protein, 67 aa, Apium graveolens (Celery)
ATCSAVQLSPCLAAITKNTPPSAACCNKLKEQKPCLCGYLKDPNLKNYVNSPGARKTASSCGVALKC

SEQ ID NO: 1493 - protein, 626 aa, Arachis hypogaea (Peanut, groundnut)
MRGRVSPLMLLLGILVLASVSATHAKSSPYQKKTENPCAQRCLQSCQQEPDDLKQKACESRCTKLEYDPRCVYDPRGHTGTTNQRSPPGERTRGRQPGDYDDDRRQPRREEGGRWGPAGPREREREEDWRQPREDWRRPSHQQPRKIRPEGREGEQEWGTPGSHVREETSRNNPFYFPSRRFSTRYGNQNGRIRVLQRFDQRSRQFQNLQNHRIVQIEAKPNTLVLPKHADADNILVIQQGQATVTVANGNNRKSFNLDEGHALRIPSGFISYILNRHDNQNLRVAKISMPVNTPGQFEDFFPASSRDQSSYLQGFSRNTLEAAFNAEFNEIRRVLLEENAGGEQEERGQRRWSTRSSENNEGVIVKVSKEHVEELTKHAKSVSKKGSEEEGDITNPINLREGEPDLSNNFGKLFEVKPDKKNPQLQDLDMMLTCVEIKEGALMLPHFNSKAMVIVVVNKGTGNLELVAVRKEQQQRGRREEEEDEDEEEEGSNREVRRYTARLKEGDVFIMPAAHPVAINASSELHLLGFGINAENNHRIFLAGDKDNVIDQIEKQAKDLAFPGSGEQVEKLIKNQKESHFVSARPQSQSQSPSSPEKESPEKEDQEEENQGGKGPLLSILKAFN

SEQ ID NO: 1494 - protein, 172 aa, Arachis hypogaea (Peanut, groundnut)
MAKLTILVALALFLLAAHASARQQWELQGDRRCQSQLERANLRPCEQHLMQKIQRDEDSYGRDPYSPSQDPYSPSQDPDRRDPYSPSPYDRRGAGSSQHQERCCNELNEFENNQRCMCEALQQIMENQSDRLQGRQQEQQFKRELRNLPQQCGLRAPQRCDLEVESGGRDRY

SEQ ID NO: 1495 - protein, 507 aa, Arachis hypogaea (Peanut, groundnut)
RQQPEENACQFQRLNAQRPDNRIESEGGYIETWNPNNQEFECAGVALSRLVLRRNALRRPFYSNAPQEIFIQQGRGYFGLIFPGCPRHYEEPHTQGRRSQSQRPPRRLQGEDQSQQQRDSHQKVHRFDEGDLIAVPTGVAFWLYNDHDTDVVAVSLTDTNNNDNQLDQFPRRFNLAGNTEQEFLRYQQQSRQSRRRSLPYSPYSPQSQPRQEEREFSPRGQHSRRERAGQEEENEGGNIFSGFTPEFLEQAFQVDDRQIVQNLRGETESEEEGAIVTVRGGLRILSPDRKRRADEEEEYDEDEYEYDEEDRRRGRGSRGRGNGIEETICTASAKKNIGRNRSPDIYNPQAGSLKTANDLNLLILRWLGPSAEYGNLYRNALFVAHYNTNAHSIIYRLRGRAHVQVVDSNGNRVYDEELQEGHVLVVPQNFAVAGKSQSENFEYVAFKTDSRPSIANLAGENSVIDNLPEEVVANSYGLQREQARQLKNNNPFKFFVPPSQQSPRAVA

SEQ ID NO: 1496 - protein, 530 aa, Arachis hypogaea (Peanut, groundnut)
MAKLLELSFCFCFLVLGASSISFRQQPEENACQFQRLNAQRPDNRIESEGGYIETWNPNNQEFECAGVALSRLVLRRNALRRPFYSNAPQEIFIQQGRGYFGLIFPGCPSTYEEPAQQGRRYQSQRPPRRLQEEDQSQQQQDSHQKVHRFNEGDLIAVPTGVAFWLYNDHDTDVVAVSLTDTNNNDNQLDQFPRRFNLAGNHEQEFLRYQQQSRQSRRRSLPYSPYSPHSRPRREEREFRPRGQHSRRERAGQEEEDEGGNIFSGFTPEFLEQAFQVDDRQIVQNLWGENESEEEGAIVTVRGGLRILSPDGTRGADEEEEYDEDQYEYHEQDGRRGRGSRGGGNGIEETICTACVKKNIGGNRSPHIYDPQRWFTQNCHDLNLLILRWLGLSAEYGNLYRNALFVPHYNTNAHSIIYALRGRAHVQVVDSNGNRVYDEELQEGHVLVVPQNFAVAGKSQSENFEYVAFKTDSRPSIANFAGENSFIDNLPEEVVANSYGLPREQARQLKNNNPFKFFVPPFQQSPRAVA

SEQ ID NO: 1497 - protein, 131 aa, Arachis hypogaea (Peanut, groundnut)
MSWQTYVDNHLLCEIEGDHLSSAAILGQDGGVWAQSSHFPQFKPEEITAIMNDFAEPGSLAPTGLYLGGTKYMVIQGEPGAIIPGKKGPGGVTIEKTNQALIIGIYDKPMTPGQCNMIVERLGDYLIDTGL

SEQ ID NO: 1498 - protein, 145 aa, Arachis hypogaea (Peanut, groundnut)
MAKSTILVALLALVLVAHASAMRRERGRQGDSSSCERQVDRVNLKPCEQHIMQRIMGEQEQYDSYDIRSTRSSDQQQRCCDELNEMENTQRCMCEALQQIMENQCDRLQDRQMVQQFKRELMNLPQQCNFRAPQRCDLDVSGGRC

SEQ ID NO: 1499 - protein, 160 aa, Arachis hypogaea (Peanut, groundnut)
MMVKLSILVALLGALLVVASATRWDPDRGSRGSRWDAPSRGDDQCQRQLQRANLRPCEEHMRRRVEQEQEQEQDEYPYSRRGSRGRQPGESDENQEQRCCNELNRFQNNQRCMCQALQQILQNQSFWVPAGQEPVASDGEGAQELAPELRVQVTKPLRPL

SEQ ID NO: 1500 - protein, 164 aa, Arachis hypogaea (Peanut, groundnut)
MVKLSILVALLGALLVVASATRWDPDRGSRGSRWDAPSRGDDQCQRQLQRANLRPCEEHIRQRVEKEQEQEQDEYPYIQRGSRGQRPGESDEDQEQRCCNELNRFQNNQRCMCQALQQILQNQSFRFQQDRSQLHQMERELRNLPQNCGFRSPSRCDLSSRTPY

SEQ ID NO: 1501 - protein, 157 aa, Arachis hypogaea (Peanut, groundnut)
MGVFTFEDEITSTVPPAKLYNAMKDADSITPKIIDDVKSVEIVEGNGGPGTIKKLTIVEDGETKFILHKVESIDEANYAYNYSVVGGVALPPTAEKITFETKLVEGPNGGSIGKLTLKYHTKGDAKPDEEELKKGKAKGEGLFRAIEGYVLANPTQY

SEQ ID NO: 1502 - protein, 153 aa, Arachis hypogaea (Peanut, groundnut)
MGVHTFEEESTSPVPPAKLFKATVVDGDELTPKLIPAIQSIEIVEGNGGPGTVKKVTAVEDGKTSYVLHKIDAIDEATYTYDYTISGGTGFQEILEKVSFKTKLEAADGGSKIKVSVTFHTKGDAPLPDEVHQDVKQKSQGIFKAIEGYVLSN

SEQ ID NO: 1503 - protein, 116 aa, Arachis hypogaea (Peanut, groundnut)
MASLKFAFVMLVCMAMVGAPMVNAISCGQVNSALAPCIPFLTKGGAPPPACCSGVRGLLGALRTTADRQAACNCLKAAAGSLRGLNQGNAAALPGRCGVSIPYKISTSTNCATIKF

SEQ ID NO: 1504 - protein, 92 aa, Arachis hypogaea (Peanut, groundnut)
LSCGQVNSALAPCITFLTKGGVPSGPCCSGVRGLLGAAKTTADRQAACNCLKAAAGSLHGLNQGNAAALPGRCGVSIPYKISTSTNCATIKF

SEQ ID NO: 1505 - protein, 169 aa, Arachis hypogaea (Peanut, groundnut)
MTDRTQPHTVQVHTTAGRFGDTAAGTNRYPDRGPSTSKVIAVITGLPIGGTLLLFAGLALAGTLLGLAVTTPLFILFSPVIVPAIIVVGLSVAGFLTSGACGLTGLSSFSWVMNYIRQTHGSVPEQLEMAKHRMADVAGYVGQKTKDVGQKTKEVGQEIQTKAQDSKRT

SEQ ID NO: 1506 - protein, 150 aa, Arachis hypogaea (Peanut, groundnut)
MTDRTQPHAVQVHTTAGRFGDTAAGTNRYADRGPSTSKVIAVITGLPIGGTLLLFAGLALAGTLLGLAVTTPLFILFSPVIVPATIVVGLSVAGFLTSGACGLTGLSSFSWVMNYIRQTHGSVPEQLEMAKHRMADVAGYVGQKTKDVGQ

SEQ ID NO: 1507 - protein, 137 aa, Arachis hypogaea (Peanut, groundnut)
MAEALYYGGRQRQEQPRSTQLVKATTAVVAGGSLLILAGLVLAGTVIGLTTITPLFVIFSPVLVPAVITVALLGLGFLASGGFGVAAITVLTWIYRYVTGKHPPGANQLDTARHKLMGKAREIKDFGQQQTSGAQAS

SEQ ID NO: 1508 - protein, 137 aa, Arachis hypogaea (Peanut, groundnut)
MAEALYYGGRQRQDQPRSTQLVKATTAVVAGGSLLILAGLVLAATVIGLTTITPLFVIFSPVLVPAVITVALLGLGFLASGGFGVAAITVLTWIYRYVTGKHPPGANQLDTARHKLMSKAREIKDYGQQQTSGAQAS

SEQ ID NO: 1509 - protein, 176 aa, Arachis hypogaea (Peanut, groundnut)
MATATDRAPHQVQVHTPTTQRVDVPRRGYDVSGGGIKTLLPERGPSTSQIIAVLVGVPTGGTLLLLSGLSLLGTIIGLAIATPVFTFFSPVIVPAVVTIGLAVTGILTAGACGLTGLMSLSWMINFIRQVHGTTVPDQLDSVKRRMADMADYVGQKTKDAGQQIQTKAQDVKRSSS

SEQ ID NO: 1510 - protein, 176 aa, Arachis hypogaea (Peanut, groundnut)
MATATDRAPHQVQVHTPTTQRVDVQRRGYDVSGGGVKTFLPDRGPSTSQIIAVLVGVPTGGTLLLLSGLSLLGTIIGLAIATPVFTFFSPVIVPAVVTIGLAVIGILTAGACGLTGLMSLSWMINFIRQVHGTTVPDQLDSAKRRMADMADYVGQKTKDAGQEIQTKAQDVKRSSS

SEQ ID NO: 1511 - protein, 176 aa, Arachis hypogaea (Peanut, groundnut)
MATATDRAPHQVQVHTPTTQRVDVPRRGYDVSGGGIKTLLPERGPSTSQIIAVLVGVPTGGTLLLLSGLSLLGTIIGLAIATPVFIFFSPVIVPAVVTIGLAVTGILTAGACGLTGLMSLSWMINFIRQVHGTTVPDQLDSVKRRMADMADYVGQKTKDAGQEIQTKAQDVKRSSS

SEQ ID NO: 1512 - protein, 166 aa, Arachis hypogaea (Peanut, groundnut)
MSDQTRTGYGGGGSYGSSYGGGGTYGSSYGTSYDPSTNQPIRQAIKFMTASTIGVSFLILSGLILTGTVIGLIIATPLLVIFSPILVPAAITLALAAGGFLFSGGCGVAAIAALSWLYSYVTGKHPAGSDRLDYAKGVIADKARDVKDRAKDYAGAGRAQEGTPGY

SEQ ID NO: 1513 - protein, 132 aa, Artemisia vulgaris (Mugwort, wormwood)
MAKCSYVFCAVLLIFIVAIGEMEAAGSKLCEKTSKTYSGKCDNKKCDKKCIEWEKAQHGACHKREAGKESCFCYFDCSKSPPGATPAPPGAAPPPAAGGSPSPPADGGSPPPPADGGSPPVDGGSPPPPSTH

SEQ ID NO: 1514 - protein, 162 aa, Artemisia vulgaris (Mugwort, wormwood)
MGHLGNFWLVLAISFAILHLSHAHETYGEPGNTPDDYVHAHNCIRRVLGMKPLCWDEIGKVAQAWAETRTPDCSLIHSDRCGENMAQGAINGSMAVQLWLDERLDYDYNENKCIKMCGHYTQIVWANSERVGCGRALCSNGWAYIIVCNYDPPGNVVGQKPY

SEQ ID NO: 1515 - protein, 37 aa, Artemisia vulgaris (Mugwort, wormwood)
ALTCSDVSNKISPCLSYLKQGGEVPADCCAGVKGLND

SEQ ID NO: 1516 - protein, 114 aa, Artemisia vulgaris (Mugwort, wormwood)
MKMMKFFCAMVVCMVVSSSYAEALKCSDVSNKISACLSYLKQGGEVPADCCTGVKGLNDAAKTTPDRQTACNCLKTTFKSNKDFKSDFAASLPSKCGVNIPYKISLETDCNKVK

SEQ ID NO: 1517 - protein, 116 aa, Artemisia vulgaris (Mugwort, wormwood)
MAMKMMKFFCAMVVCMVLSSSYAEALTCSDVSNKITPCLNYLKQGGEVPADCCTGVKGLNDAAKTTPDRQTACNCLKTSFKSNKDLKSDFAASLPSKCGVNIPYKISLETDCNKVK

SEQ ID NO: 1518 - protein, 117 aa, Artemisia vulgaris (Mugwort, wormwood)
MAIKMMKVFCIMVVCMVVSTSYAESALTCSDVSTKISPCLSYLKKGGEVPADCCTGVKGLNDATKTTPDRQTACNCLKASFKSNKDLKSDFAVPLPSKCGLNLPYKLSLETDCNKVK

SEQ ID NO: 1519 - protein, 133 aa, Artemisia vulgaris (Mugwort, wormwood)
MSWQTYVDDHLMCDIEGTGQHLTSAAIFGTDGTVWAKSASFPEFKPNEIDAIIKEFNEAGQLAPTGLFLGGAKYMVIQGEAGAVIRGKKGAGGICIKKTGQAMVFGIYDEPVAPGQCNMVVERLGDYLLDQGM

SEQ ID NO: 1520 - protein, 133 aa, Artemisia vulgaris (Mugwort, wormwood)
MSWQTYVDDHLMCDIEGTGQHLTAAAILGLDGTVWAKSDKFPEFKPEEMKGIINEFNEVGTLAPTGLFLGGAKYMVLQGEAGAVIRGKKGAGGICIKKTGQAMVMGIYDEPVAPGQCNMIVERLGDYLVDQNM

SEQ ID NO: 1521 - protein, 82 aa, Artemisia vulgaris (Mugwort, wormwood)
MADEDKAECDRIFGAFDKNGDGKISAAELGESLTKLGSVSPEEVQTMMDELDTDGDGYISYDEFAEFFNANRGLMKDVGKIF

SEQ ID NO: 1522 - protein, 396 aa, Artemisia vulgaris (Mugwort, wormwood)
MEKHYFVILFTAAFVFVGAAARADIGDELEAAQFNSTRRGLHECAAHNIIDKCWRCKADWEKNRQALAKCAQGFAKGTTGGLGGEIYVVTDCSDDNAANPKPGTLRCGVTQDKPLWIIFKKDMVIKLKHELVINKDKTIDGRGANVEITCGGLTIHNVCNVIIHNIHIHDIKVTEGGIIKATDAKPGHRHKSDGDGICVAGSSKIWIDHCTLSHGPDGLIDVTLGSTAVTISNCKFSHHQKILLLGADNSHVDDKKMHVTVAFNRFAEACDQRMPRCRFGFFQVVNNDYTSWGTYAIGGSANPTILSQGNRFHAPNDPMKKNVLVRADAPHTESMKWNWRSEKDLLENGAIFVASGCDPHLTPEQKSHLIPAEPGSAVLQLTSCAGTLKCVPGKPC

SEQ ID NO: 1523 - protein, 146 aa, Bertholletia excelsa (Brazil nut)
MAKISVAAAALLVLMALGHATAFRATVTTTVVEEENQEECREQMQRQQMLSHCRMYMRQQMEESPYQTMPRRGMEPHMSECCEQLEGMDESCRCEGLRMMMMRMQQEEMQPRGEQMRRMMRLAENIPSRCNLSPMRCPMGGSIAGF

SEQ ID NO: 1524 - protein, 465 aa, Bertholletia excelsa (Brazil nut)
MAKLFLLSLGIFLLFHCCLAIEYEQEELYECRIQRLTAQEPQYRLEAEAGVSEVWDYTDQQFRCAGVAALRNTIRPQGLLLPVYTNAPKLYYVTQGRGILGVLMPGCPETFQSMSQFQGSREQEEERGRFQDQHQKVHHLKKGDIIAIPAGVALWCYNDGDEDLVTVLVQHTASDLNQLDQNPRHFFLAGNIQRSQKQRGERYGLRGGQQILADNVFKGFNMEALADVLGFGMDTETARKVRGEDDQRGHIVRVEQGLKVIRPPRIREELEQQEGGGYNGLEETICSATFIQNIDNPAEADFYNPRAGRLTTVNSLKVPILTFLQLSAMKGVLYENAMMAPLWRLNANSVVYAVRGEARVQIVDHRGETVFDDNLREGQMVVVPQNFVVVKQAGSRGFEWVVFNTNDNALFSTAAGRTSPLRGIPVGVLANAYRLSQEEARRIKLNRDEAVLFQPGSRSRGRASA

SEQ ID NO: 1525 - protein, 20 aa, Beta vulgaris (Sugar beet)
VQGMVYCDTCRSANALGFMR

SEQ ID NO: 1526 - protein, 23 aa, Beta vulgaris (Sugar beet)
YMVIQGEPGAVIRLGDYLIDQGL

SEQ ID NO: 1527 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVDHTNFKYNYSVIEGGPIGDTLEKISNEIKIVATPDGGSILKISNKYHTKGDHEVKAEQVKASKEMGETLLRAVESYLLAHSDAYN

SEQ ID NO: 1528 - protein, 160 aa, Betula verrucosa (Betula pendula) (European white birch)
MGVFNYEIETTSVIPAARLFKAFILDGDNLVPKVAPQAISSVENIEGNGGPGTIKKINFPEGFPFKYVKDRVDEVDHTNFKYNYSVIEGGPVGDTLEKISNEIKIVATPDGGCVLKISNKYHTKGNHEVKAEQVKASKEMGETLLRAVESYLLAHSDAYN

SEQ ID NO: 1529 - protein, 160 aa, Betula verrucosa (Betula pendula) (European white birch)
MGVFNYETEATSVIPAARLFKAFILDGDNLFPKVAPQAISSVENIEGNGGPGTIKKISFPEGIPFKYVKGRVDEVDHTNFKYSYSVIEGGPVGDTLEKISNEIKIVATPNGGSILKINNKYHTKGDHEVKAEQIKASKEMGETLLRAVESYLLAHSDAYN

SEQ ID NO: 1530 - protein, 160 aa, Betula verrucosa (Betula pendula) (European white birch)
MGVFNYEIEATSVIPAARLFKAFILDGDNLFPKVAPQAISSVENIEGNGGPGTIKKISFPEGFPFKYVKDRVDEVDHTNFKYSYSVIEGGPVGDTLEKISNEIKIVATPNGGSILKINNKYHTKGDHEVKAEQIKASKEMGETLLRAVESYLLAHSDAYN

SEQ ID NO: 1531 - protein, 160 aa, Betula verrucosa (Betula pendula) (European white birch)
MGVFNYESETTSVIPAARLFKAFILEGDNLIPKVAPQAISSVENIEGNGGPGTIKKINFPEGFPFKYVKDRVDEVDHTNFKYNYSVIEGGPVGDTLEKISNEIKIVATPDGGCVLKISNKYHTKGNHEVKAEQVKASKEMGETLLRAVESYLLAHSDAYN

SEQ ID NO: 1532 - protein, 160 aa, Betula verrucosa (Betula pendula) (European white birch)
MGVFNYETEATSVIPAARLFKAFILDGDNLFPKVAPQAISSVENIEGNGGPGTIKKISFPEGFPFKYVKDRVDEVDHTNFKYSYSVIEGGPVGDTLEKISNEIKIVATPNGGSILKINNKYHTKGDHEVKAEQIKASKEMGETLLRAVESYLLAHSDAYN

SEQ ID NO: 1533 - protein, 160 aa, Betula verrucosa (Betula pendula) (European white birch)
MGVFNYETEATSVIPAARMFKAFILDGDKLVPKVAPQAISSVENIEGNGGPGTIKKINFPEGFPFKYVKDRVDEVDHTNFKYNYSVIEGGPVGDTLEKISNEIKIVATPDGGCVLKISNKYHTKGNHEVKAEQVKASKEMGETLLRAVESYLLAHSDAYN

SEQ ID NO: 1534 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVDHTNFKYNYSVIEGGPVGDTLEKISNEIKIVATPDGGCVLKISNKYHTKGNHEVKAEQVKASKEMGETLLRAVESYLLAHSDAYN

SEQ ID NO: 1535 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVDHTNFKYNYSVIEGGPVGDTLEKISNEIKIVATPDGGSILKISNKYHTKGDHEVKAEQVKASKEMGETLLRAVESYLLAHSDAYN

SEQ ID NO: 1536 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVDHTNFKYNYSVIEGGPIGDILEKISNEIKIVATPDGGCVLKISNKYHTKGNHEVKAEQVKASKEMGETLLRAVESYLLAHSDAYN

SEQ ID NO: 1537 - protein, 160 aa, Betula verrucosa (Betula pendula) (European white birch)
MGVFNYETETTSVIPAARLFKAFILDGDNLFPKVAPQAISSVENIEGNGGPGTIKKISFPGGLPFKYVKDRVDEVDHTNFKYNYSVIEGGPIGDTLEKISNEIKIVATPDGGCVLKISNKYHTKGNHEVKAEQVKASKEMGETLLRAVESYLLAHSDAYN

SEQ ID NO: 1538 - protein, 160 aa, Betula verrucosa (Betula pendula) (European white birch); identical to SEQ ID NO: 1527

SEQ ID NO: 1539 - protein, 160 aa, Betula verrucosa (Betula pendula) (European white birch)
MGVFNYETETTSVIPAARLFKAFILDGDNLVPKVAPQAISSVENIEGNGGPGTIKKISFPEGFPFKYVKDRVDEVDHTNFKYNYSVIEGGPMGDTLEKISNEIKIVATPDGGSILKISNKYHTKGDHEVKAEQVKASKEMGETLLRAVESYLLAHSDAYN

SEQ ID NO: 1540 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVDHTNFKYNYSVIEGGPIGDTLEKISNEIKIVATPDGGSILKISNKYHTKGDHEVKAEQVKASKEMRETLLRAVESYLLAHSDAYN

SEQ ID NO: 1541 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVAHKNFKYSYSVIEGGPIGDTLEKISNEIKIVATPDGRSILKISNKYHTKGDHEVKAEQIKASKEMGETLLRAVESYLLAHSDAYN

SEQ ID NO: 1542 - protein, 159 aa, Betula verrucosa (Betula pendula) (European white birch)
GVFNYETEATSVIPAARLFKAFILDGDNLFPKVAPQAISSVENIEGNGGPGTIKKISFPEGIPFKYVKDRVDEVDHANFKYSYSLIEGGPVGDTLEKISNEIKIVATPDGGSILKISNKYHTKGDHEVKAEQVKASKEMGETLLRAVESYLLAHSDAYN

SEQ ID NO: 1543 - protein, 160 aa, Betula verrucosa (Betula pendula) (European white birch)
MGVFNYETETTSVIPAARLFKAFILDGDNLFPKVAPQAISSVENIEGNGGPGTIKKISFPEGFPFKYVKDRVDEVDHTNFKYNYSVIEGGPIGDTLEKISNEIKIVATPDGGCVLKISNKYHTKGNHEVKAEQVKASKEMGETLLRAVESYLLAHSDAYN

SEQ ID NO: 1544 - protein, 160 aa, Betula verrucosa (Betula pendula) (European white birch)
MGVFNYETETTSVIPAARLFKAFILDGDNLIPKVAPQAISSVENIEGNGGPGTIKKISFPEGFPFKYVKDRVDEVDHTNFKYNYSVIEGGPIGDTLEKISNEIKLVATPDGGSILEISNKYHTKGDHEMKAEHMKAIKEKGEALLRAVESYLLAHSDAYN

SEQ ID NO: 1545 - protein, 150 aa, Betula verrucosa (Betula pendula) (European white birch)
FNYETETTSVIPAARLFKAFILDGDNLFPKVAPQAISSVQNIEGNGGPGTIKKINFPEGFPFKYVKDRVDEVDHTNFKYNYSVIEGGPVGDTLEKISNEIKIVATPDGGCILKISNKYHTKGNHEVKAEQVKASKEMGETLLRAVESYLL

SEQ ID NO: 1546 - protein, 160 aa, Betula verrucosa (Betula pendula) (European white birch)
MGVFNYETETTSVIPAARLFKAFILEGDTLIPKVAPQAISSVENIEGNGGPGTIKKITFPEGSPFKYVKERVDEVDHANFKYSYSMIEGGALGDTLEKICNEIKIVATPDGGSILKISNKYHTKGDHEMKAEHMKAIKEKGEALLRAVESYLLAHSDAYN

SEQ ID NO: 1547 - protein, 160 aa, Betula verrucosa (Betula pendula) (European white birch)
MGVFNYESETTSVIPAARLFKAFILEGDTLIPKVAPQAISSVENIEGNGGPGTIKKITFPEGSPFKYVKERVDEVDHANFKYSYSMIEGGALGDTLEKICNEIKIVATPDGGSILKISNKYHTKGDQEMKAEHMKAIKEKGEALLRAVESYLLAHSDAYN

SEQ ID NO: 1548 - protein, 160 aa, Betula verrucosa (Betula pendula) (European white birch)
MGVFNYESETTSVIPAARLFKAFILEGDTLIPKVAPQAISSVENIEGNGGPGTIKKITFPEGSPFKYVKERVDEVDHANFKYSYSMIEGGALGDTLEKICNEIKIVATPDGGSILKISNKYHTKGDHEMKAEHMKAIKEKGEALLRAVESYLLAHSDAYN

SEQ ID NO: 1549 - protein, 160 aa, Betula verrucosa (Betula pendula) (European white birch)
MGVFNYESETTSVIPAARLFKAFILDGDNLIPKVAPQAISSVENIEGNGGPGTIKKITFPEGSPFKYVKERVDEVDHANFKYSYSMIEGGALGDTLEKICNEIKIVATPDGGSILKISNKYHTKGDHEMKAEHMKAIKEKGEALLRAVESYLLAHSDAYN

SEQ ID NO: 1550 - protein, 160 aa, Betula verrucosa (Betula pendula) (European white birch)
MGVFNYETETTSVIPAARLFKAFILDGDNLIPKVAPQAISSVENIEGNGGPGTIKKITFPEGSPFKYVKERVDEVDHANFKYSYSMIEGGALGDTLEKICNEIKLVATPDGGSILKISNKYHTKGDHEMKAEHMKAIKEKAEALLRAVESYLLAHSDAYN

SEQ ID NO: 1551 - protein, 159 aa, Betula verrucosa (Betula pendula) (European white birch)
GVFNYESETTSVIPAARLFKAFILDGDNLIPKVAPQAISSVENIEGNGGPGTIKKITFPEGSPFKYVKERVDEVDHANFKYSYSMIEGGALGDTLEKICNEIKLVATPDGGSILKISNKYHTKGDHEMKAEHMKAIKEKGETLLRAVESYLLAHSDAYN

SEQ ID NO: 1552 - protein, 150 aa, Betula verrucosa (Betula pendula) (European white birch)
FNYESETTSVIPAARLFKAFILEGDNLIPKVAPQAISSVENIEGNGGPGTIKKITFPEGSPFKYVKERVDEVDHANFKYSYSMIEGGALGDTLEKICNEIKIVATPDGGSILKISNKYHTKGDHEMKAEHMKAIKEKGEALLRAVESYLL

SEQ ID NO: 1553 - protein, 160 aa, Betula verrucosa (Betula pendula) (European white birch)
MGVFNYEDEATSVIAPARLFKSFVLDADNLIPKVAPENVSSAENIEGNGGPGTIKKITFPEGSHFKYMKHRVDEIDHANFKYCYSIIEGGPLGDTLEKISYEIKIVAAPGGGSILKITSKYHTKGDISLNEEEIKAGKEKGAGLFKAVENYLVAHPNAYN

SEQ ID NO: 1554 - protein, 133 aa, Betula verrucosa (Betula pendula) (European white birch)
MSWQTYVDEHLMCDIDGQASNSLASAIVGHDGSVWAQSSSFPQFKPQEITGIMKDFEEPGHLAPTGLHLGGIKYMVIQGEAGAVIRGKKGSGGITIKKTGQALVFGIYEEPVTPGQCNMVVERLGDYLIDQGL

SEQ ID NO: 1555 - protein, 205 aa, Betula verrucosa (Betula pendula) (European white birch)
MPCSTEAMEKAGHGHASTPRKRSLSNSSFRLRSESLNTLRLRRIFDLFDKNSDGIITVDELSRALNLLGLETDLSELESTVKSFTREGNIGLQFEDFISLHQSLNDSYFAYGGEDEDDNEEDMRKSILSQEEADSFGGFKVFDEDGDGYISARELQMVLGKLGFSEGSEIDRVEKMIVSVDSNRDGRVDFFEFKDMMRSVLVRSS

SEQ ID NO: 1556 - protein, 85 aa, Betula verrucosa (Betula pendula) (European white birch)
MADDHPQDKAERERIFKRFDANGDGKISAAELGEALKTLGSITPDEVKHMMAEIDTDGDGFISFQEFTDFGRANRGLLKDVAKIF

SEQ ID NO: 1557 - protein, 300 aa, Betula verrucosa (Betula pendula) (European white birch)
MAHKSKILIIGGTGYIGKFIVEASAKSGHPTFALVRESTVSDPVKGKLVEKFKGLGVTLLHGDLYDHESLVKAFKQVDVVISTVGHLQLADQVKIIAAIKEAGNIKRFFPSEFGNDVDRVHAVEPAKTAFATKAEIRRKTEAEGIPYTYVSSNFFAGYFLPTLAQPGLTSPPREKVVIFGDGNARAVFNKEDDIGTYTIRAVDDPRTLNKIVYIKPAKNIYSFNEIVALWEKKIGKTLEKIYVPEEKLLKDIQESPIPINVILAINHSVFVKGDHTNFEIEASFGVEASELYPDVKYTTV

SEQ ID NO: 1558 - protein, 308 aa, Betula verrucosa (Betula pendula) (European white birch)
MAHKSKILIIGGTGYIGKFIVEASAKSGHPTFALVRESTVSDPVKGKLVEKFKGLGVTLLHGDLYDHESLVKAFKQVDVVISTVGHLQLADQVKIIAAIKEAGNIKRFFPSEFGNDVDRVHAVEPAKTAFATKAEIRRKTEAEGIPYTYVSSNFFAGYFLPTLAQPGLTSPPREKVVIFGDGNARAVFNKEDDIGTYTIRAVDDPRTLNKIVYIKPAKNIYSFNEIVALWEKKIGKTLEKIYVPEEKLLKDIQESPIPINVILAINHSVFVKGDHTNFEIEASFGVEASELYPDVKYTTVEEYLQQFV

SEQ ID NO: 1559 - protein, 42 aa, Betula verrucosa (Betula pendula) (European white birch)
  misc_feature (19)..(25): Xaa can be any naturally occurring amino acid
DFTAGNGTGGESIYGAKDXXXXXXXTGPGILSMANAGPGTNG

SEQ ID NO: 1560 - protein, 129 aa, Brassica juncea (Indian or oriental mustard)
AGPFRFPRCRKEFQQAQHLRACQQWLHKQAMQSGSGPQPQGPQQRPPLLQQCCNELHQEEPLCVCPTLKGASKAVKQQIRQQGQQQGQQGQQLQHEISRIYQTATHLPRVCNIPRVSICPFQKTMPGPS

SEQ ID NO: 1561 - protein, 125 aa, Brassica napus (Rapeseed)
SAGPFRIPKCRKEFQQAQHLRACQQWLHKQAMQSGSGPQGPQQRPPLLQQCCNELHQEEPLCVCPTLKGASRAVKQQVRQQQGQQGQQLQQVISRIYQTATHLPKVCNIPQVSVCPFQKTMPGPS

SEQ ID NO: 1562 - protein, 178 aa, Brassica rapa (Field mustard or Turnip)
MANKLFLVSATLALFFLLTNASVYRTGSEFDEHDATNPAGPFRIPKCRKEFQQAQHLKACQQWLHKQAMQSGSGPSWTLDGEFDFEEDMENTQGPQQEPPLLQQCCNELHQEEPLCVCPTLKGASKAVKQQVRQQGQQQQMQQVISRIYQTSTHLPRVCNIRQVSICPFQKTMPGPSY

SEQ ID NO: 1563 - protein, 91 aa, Brassica rapa (Field mustard or Turnip)
QAGGQTCAGNICCSQYGYCGTTADYCSPDNNCQATYHYYNPAQNNWDLRAVSAYCSTWDADKPYSWRYGWTAFCGPAGPRCLRTNAAVTVR

SEQ ID NO: 1564 - protein, 79 aa, Brassica rapa (Field mustard or Turnip)
MADAEHERIFKKFDTDGDGKISAAELEEALKKLGSVTPDDVTRMMAKIDTDGDGNISFQEFTEFASANPGLMKDVAKVF

SEQ ID NO: 1565 - protein, 91 aa, Cannabis sativa (Indian hemp)
ITCGQVASSLAPCLSYLKVGGAVPDGCCNDIKSLSGAAKTPADRQAACKCLKSAASSIKGVNFNLASGLPGKCGVSIPYKISPSTDCSSVK

SEQ ID NO: 1566 - protein, 246 aa, Capsicum annuum (Chilli or bell pepper)
MGYLRSSFVLFLLAFVTYTYAATFEVRNNCPYTVWAASTPVGGGRRLDRGQTWTINAPPGTAMARIWGRTNCNFDGSGRGSCQTGDCGGVLQCTGWGKPPNTLAEYALNQFNNLDFWDISLVDGFNIPMTFAPTNPSGGKCHAIQCTANINGECPGSLRVPGGCNNPCTTFGGQQYCCTQGPCGPTELSKFFKKRCPDAYSYPQDDATSTFTCPSGSTNYRVVFCPNGVTGPNFPLEMPGSDGVAK

SEQ ID NO: 1567 - protein, 131 aa, Capsicum annuum (Chilli or bell pepper)
MSWQTYVDDHLMCEIEGNRLTSAAIIGQDGSVWAQSATFPQFKPEEITAIMNDFAEPGTLAPTGLYLGGTKYMVIQGEAGAVIRGKKGPGGITVKKTNQALIIGIYDEPMTPGQCNMIVERLGDYLIEQSL

SEQ ID NO: 1568 - protein, 160 aa, Carpinus betulus (Hornbeam)
MGVFNYEAETPSVIPAARLFKSYVLDGDKLIPKVAPQVISSVENVGGNGGPGTIKNITFAEGIPFKFVKERVDEVDNANFKYNYTVIEGDVLGDKLEKVSHELKIVAAPGGGSIVKISSKFHAKGYHEVNAEKMKGAKEMAEKLLRAVESYLLAHTAEYN

SEQ ID NO: 1569 - protein, 143 aa, Carya illinoinensis (Pecan)
MARVAALLVALLFVANAAAFRTTITTMEIDEDIDNPRRRGESCREQIQRQQYLNRCQDYLRQQCRSGGYDEDNQRQHFRQCCQQLSQMEEQCQCEGLRQAVRQQQQEEGIRGEEMEEMVQCASDLPKECGISSRSCEIRRSWF

SEQ ID NO: 1570 - protein, 792 aa, Carya illinoinensis (Pecan)
MVTKAKIPLFLFLSALFLALVCSSLALETEDLSNELNPHHDPESHRWEFQQCQERCQHEERGQRQAQQCQRRCEEQLREREREREREEIVDPREPRKQYEQCRETCEKQDPRQQPQCERRCERQFQEQQERERRERRRGRDDDDKENPRDPREQYRQCEEHCRRQGQGQRQQQQCQSRCEERFEEEQRRQEERERRRGRDNDDEENPRDPREQYRQCQEHCRRQGQGQRQQQQCQSRCEERLEEEQRKQEERERRRGRDEDDQNPRDPEQRYEQCQQQCERQRRGQEQQLCRRRCEQQRQQEERERQRGRDRQDPQQQYHRCQRRCQTQEQSPERQRQCQQRCERQYKEQQGREWGPDQASPRRESRGREEEQQRHNPYYFHSQGLRSRHESGEGEVKYLERFTERTELLRGIENYRVVILEANPNTFVLPYHKDAESVIVVTRGRATLTFVSQERRESFNLEYGDVIRVPAGATEYVINQDSNERLEMVKLLQPVNNPGQFREYYAAGAQSTESYLRVFSNDILVAALNTPRDRLERFFDQQEQREGVIIRASQEKLRALSQHAMSAGQRPWGRRSSGGPISLKSQRSSYSNQFGQFFEACPEEHRQLQEMDVLVNYAEIKRGAMMVPHYNSKATVVVYVVEGTGRFEMACPHDVSSQSYEYKGRREQEEEESSTGQFQKVTARLARGDIFVIPAGHPIAITASQNENLRLVGFGINGKNNQRNFLAGQNNIINQLEREAKELSFNMPREEIEEIFERQVESYFVPMERQSRRGQGRDHPLASILDFAGFF

SEQ ID NO: 1571 - protein, 505 aa, Carya illinoinensis (Pecan)
MAKPILLSIYLCLIIVALFNGCLAQSGGRQQHKFGQCQLNRLDALEPTNRIEAEAGVIESWDPNHQQLQCAGVAVVRRTIEPNGLLLPHYSNAPQLVYIARGRGITGVLFPGCPETFEESQRQSQQGQRREFQQDRHQKIRHFREGDIIAFPAGVAHWCYNDGSSPVVAIFLLDTHNNANQLDQNPRNFYLAGNPDDEFRPQGQQEYEQHRRQQQHQQRRGEHGEQQRDLGNNVFSGFDAEFLADAFNVDTETARRLQSENDHRGSIVRVEGRQLQVIRPRWSREEQEHEERKERERERESESERRQSRRGGRDDNGLEETICTLSLRENIGDPSRADIYTEEAGRISTVNSHNLPILRWLQLSAERGALYSDALYVPHWNLNAHSVVYALRGRAEVQVVDNFGQTVFDDELREGQLLTIPQNFAVVKRARDEGFEWVSFKTNENAMVSPLAGRTSAIRALPEEVLVNAFQIPREDARRLKFNRQESTLVRSRSRSSRSERRAEV

SEQ ID NO: 1572 - protein, 159 aa, Castanea sativa (Chestnut)
MGVFTHESQETSVIPPARLFKAFVLDSDNLIPKVLPQAIKSTEIIEGNGGPGTIKKITFGEASKYKYSKHRIDALDPENCTYSFSVIEGDVLTDIENVSTETKFVASPDGGTIMKSTTKYQTKGDFQLKEEQVQAAIEKATGLFKAVEAYLLANPDLYK

SEQ ID NO: 1573 - protein, 316 aa, Castanea sativa (Chestnut)
MKLFSLLLFLAFLLGTSAEQCGRQAGGAACANNLCCSQFGWCGNTAEYCGAGCQSQCSSPTTTTSSPTASSGGGGDVGSLISASLFDQMLKYRNDPRCKSNGFYTYNAFIAAARSFNGFGTTGDVTTRKRELAAFLAQTSHETTGGWATAPDGPYAWGYCFVMENNKQTYCTSKSWPCVFGKQYYGRGPIQLTHNYNYGQAGKAIGADLINNPDLVATNPTISFKTAIWFWMTPQANKPSSHDVIIGNWRPSAADTSAGRVPSYGVITNIINGGLECGHGSDDRVANRIGFYKRYCDTLGVSYGNNLDCYNQKPFA

SEQ ID NO: 1574 - protein, 154 aa, Castanea sativa (Chestnut)
MALSLFGGRRSNVFDPFSLDIWDPFEGFSAVANVPPSARETTAFATARIDWKETPEAHIFKADLPGLKKEEVKVEVEDGNVLQISGERSKEHEEKNDKWHRVERSCGKFLRRFRLPENAKVEQVKANMENGVLTVIVPKEEQKKTEVKSIEISG

SEQ ID NO: 1575 - protein, 172 aa, Catharanthus roseus (Rosy periwinkle)
MPNPRVFFDMSVGGQPAGRIVMELFADTTPRTAENFRALCTGEKGTGRSGKPLHYKDSSFHRVIPGFMCQGGDFTAGNGTGGESIYGAKFADENFIKKHTGPGILSMANAGPNTNGSQFFICTAKTEWLDGKHVVFGQVVEGMDVVKAIEKVGSSSGRTAKKVVVEDCGQLS

SEQ ID NO: 1576 - protein, 168 aa, Chenopodium album (Lambsquarters)
MAKCQAVFLLVGALCVLSLAGVANAAENHFKVQGMVYCDTCRIQFMTRISTIMEGATVKLECRNITAGTQTFKAEAVTDKVGQYSIPVNGDFEDDICEIELVKSPNSECSEVSHDVYAKQSAKVSLTSNNGEASDIRSANALGFMRKEPLKECPEVLKELDLYDVKAN

SEQ ID NO: 1577 - protein, 131 aa, Chenopodium album (Lambsquarters)
MSWQTYVDDHLMCDIEGNHLSSAAILGHDGTVWAQSPSFPQLKPEEVSAIMKDFNEPGSLAPTGLHLGGTKYMVIQGEPGDVIRGKKGPGGVTIKKTNQALIIGIYGEPMTPGQCNMVVERIGDYLVEQGM

SEQ ID NO: 1578 - protein, 86 aa, Chenopodium album (Lambsquarters)
MAAEDTPQDIADRERIFKRFDTNGDGKISSSELGDALKTLGSVTPDEVRRMMAEIDTDGDGFISFDEFTDFARANRGLVKDVSKIF

SEQ ID NO: 1579 - protein, 131 aa, Citrullus lanatus (watermellon)
MSWQAYVDDHLMCEIEGNHLTSAAIIGQDGSVWAKSENFPQLKPEEITGILNDFNEPGTLAPTGLYIGGSKYMVIQGEPGAVIRGKKGPGGVTVKKTALALVIGIYDEPMTPGQCNMIVERLGDYLIEQGL

SEQ ID NO: 1580 - protein, 20 aa, Citrus limon (Lemon)
  misc_feature (13)..(13): Xaa can be any naturally occurring amino acid
ITCGQVTGSLAPXIPFLRTG

SEQ ID NO: 1581 - protein, 20 aa, Citrus reticulata (Tangerine)
  misc_feature (3)..(3): Xaa can be any naturally occurring amino acid
  misc_feature (13)..(13): Xaa can be any naturally occurring amino acid
ITXGQVTGSLAPXIAFLRTK

SEQ ID NO: 1582 - protein, 25 aa, Citrus sinensis (Sweet orange)
  misc_feature (10)..(10): Xaa can be any naturally occurring amino acid
  misc_feature (18)..(18): Xaa can be any naturally occurring amino acid
TDPGHLQDVXVAINDPKXGVFVNRK

SEQ ID NO: 1583 - protein, 131 aa, Citrus sinensis (Sweet orange)
MSWQAYVDDHLMCDIDGNRLTAAAILGQDGSVWSQSATFPAFRLEEIAAILKDFDQPGTLAPTGLFLGGTKYMVIQGEAGAVIRGKKGSGGIIVKKTNQALIIGIYDEPLTPGQCNMIVERLGDYLIEQGL

SEQ ID NO: 1584 - protein, 91 aa, Citrus sinensis (Sweet orange)
ITCGQVTGSLAPCIVYLRSGGPIPVPCCNGVRSLNAAARTTPDRQTACNCLKQAAGSIPNLNPNNAVGLPRACGVSIPYKISISTDCSKVR

SEQ ID NO: 1585 - protein, 263 aa, Coffea arabica (Arabian coffee)
AGIVRYWGRGHDEPSSLAEFGRQEFATDVNIAFLEDFGGGRMPELNISHPLPSASDIEYCQKHQTKVFISIAGQPSLSSVEDAEEVAAYVWNTYLGGKSSDRPFGKAVLDGVELHIHSGNTTYLDDLARALKGYSNVISAVAAECPIPDPALDTTIRTGVVDQVRVEFFDNPSCQFTPPKDTSLLFPSWDNWSDYPGVHKLYLGIPISPTIAPEGGYIPPNELVYHVLPYLKKSPVYGGIMVFPYLHHEVNFQSMLRSYARAA

SEQ ID NO: 1586 - protein, 80 aa, Coffea arabica (Arabian coffee)
MSCCGGNCGCGAGCKCSGGCGGCKMYPELSYTENTAAETLILGVAPPKTAYLEGAGEEAAAENGGCKCGPDCKCNPCNCK

SEQ ID NO: 1587 - protein, 65 aa, Coffea arabica (Arabian coffee)
MSDKCGNCDCADRSQCVKKGSSYAADIVETENTFVETFVMMEGGAQNGKCKCGPSCACVNCTCDN

SEQ ID NO: 1588 - protein, 160 aa, Corylus avellana (Hazelnut)
MGVFNYEVETPSVIPAARLFKSYVLDGDKLIPKVAPQAITSVENVEGNGGPGTIKNITFGEGSRYKYVKERVDEVDNTNFTYSYTVIEGDVLGDKLEKVCHELKIVAAPGGGSILKISSKFHAKGDHEINAEEMKGAKEMAEKLLRAVETYLLAHSAEYN

SEQ ID NO: 1589 - protein, 160 aa, Corylus avellana (Hazelnut)
MGVFNYETESTSVIPAARLFKAFILDGNNLIPKVAPQAVSSVENVEGNGGPGTIKKITFSEGSPFKYVKERVEEVDHTNFKYSYTVIEGGPVGDKVEKICNEIKIVAAPDGGSILKISNKYHTKGDHEVDAEHIKGGKEKVEGLFRAVEAYLLAHSDAYN

SEQ ID NO: 1590 - protein, 160 aa, Corylus avellana (Hazelnut)
MGVFNYETETTSVIPPARLFKRFVLDSDNLIPKVAPKAIKSIEIIEGNGGPGTIKKICFDEGSPFNYIKQKVEEIDQANFSYRYSVIEGDALSDKLEKINYEIKIVASPHGGSILKSISKYHTIGDHELKDEQIKAGKEKASGLFKAVEGYLLAHSDAYN

SEQ ID NO: 1591 - protein, 161 aa, Corylus avellana (Hazelnut)
MGVFCYEDEATSVIPPARLFKSFVLDADNLIPKVAPQHFTSAENLEGNGGPGTIKKITFAEGNEFKYMKHKVEEIDHANFKYCYSIIEGGPLGHTLEKISYEIKMAAAPHGGGSILKITSKYHTKGNASINEEEIKAGKEKAAGLFKAVEAYLLAHPDAYC

SEQ ID NO: 1592 - protein, 161 aa, Corylus avellana (Hazelnut)
MGVFSYEDEATSVIPPARLFKSFVLDADNLIPKVAPQHFTGAENLEGNGGPGTIKKITFAEGSEFKYMKHKVEEIDHANFKYCYSIIEGGPLGHTLEKISYEIKMAAAPHGGGSILKITSKYHTKGNASISEEEIKAGKEKAAGLFKAVEAYLLAHPDTYC

SEQ ID NO: 1593 - protein, 161 aa, Corylus avellana (Hazelnut)
MGVFCYEDEATSVIPPARLFKSFVLDADNLIPKVAPQHFTGAENLEGNGGPGTIKKITFAEGSEFKYMKHKVEEIDHANFKYCYSIIEGGPLGHTLEKISYEIKMAAAPHGGGSILKITSKYHTKGNASISEEEIKAGKEKAAGLFKAVEAYLLAHPDTYC

SEQ ID NO: 1594 - protein, 161 aa, Corylus avellana (Hazelnut)
MGVFSYEDEATSVIPPARLFKSFVLDADNLIPKVAPQHFTSAENLEGNGGPGTIKKITFAEGNEFKYMKHKVEEIDHANFKYCYSIIEGGPLGHTLEKIPYEIKMAAAPHGGGSILKITSKYHTKGNASINEEEIKAGKEKAAGLFKAVEAYLLAHPDAYC

SEQ ID NO: 1595 - protein, 131 aa, Corylus avellana (Hazelnut)
MSWQTYGDEHLMCEIEGNRLAAAAIIGHDGSVWAQSSTFPQLKPEEITGVMNDFNEPGSLAPTGLYLGGTKYMVIQGEPGAVIRRKKGPGGVTVKKTSQALIIGIYDEPMTPGQCNMIVERLGDYLIDQGL

SEQ ID NO: 1596 - protein, 131 aa, Corylus avellana (Hazelnut)
MSWQAYGDEHLMCEIEGNRLAAAAIIGHDGSVWAQSSTFPQLKPEEITGVMNDFNEPGSLAPTGLYLGGTKYMVIQGEPGAVIRGKKGPGGVTVKKTSQALIIGIYDEPMTPGQCNMIVERLGDYLIDQGL

SEQ ID NO: 1597 - protein, 115 aa, Corylus avellana (Hazelnut)
MGSLKLVCAVLLCMMVAAPVARASLTCPQIKGNLTPCVLYLKNGGVLPPSCCKGVRAVNDASRTTSDRQSACNCLKDTAKGIAGLNPNLAAGLPGKCGVNIPYKISPSTNCNNVK

SEQ ID NO: 1598 - protein, 515 aa, Corylus avellana (Hazelnut)
MAKLILVSFSLCLLVLFNGCLGINVGLRRQQQRYFGECNLDRLNALEPTNRIEAEACQIESWDHNDQQFQCAGVAVIRRTIEPNGLLLPQYSNAPELIYIERGRGITGVLFPGCPETFEDPQQQSQQGQRQGQGQSQRSEQDRHQKIRHFREGDIIALPAGVAHWCYNDGDSPVVTVSLLHTNNYANQLDENPRHFYLAGNPDDEHQRQGQQQFGQRRRQQQHSHGEQGEQEQQGEGNNVFSGFDAEFLADAFNVDVDTARRLQSNQDKRRNIVKVEGRLQVVRPERSRQEWERQERQERESEQERERQRRQGGRGRDVNGFEETICSLRLRENICTRSRADIYTEQVGRINTVNSNTLPVLRWLQLSAERGDLQREGLYVPHWNLNAHSVVYAIRGRARVQVVDDNGNTVFDDELRQGQVLTIPQNFAVAKRAESEGFEWVAFKTNDNAQISPLAGRTSAIRALPDDVLANAFQISREEARRLKYNRQETTLVRSSRSSSERKRRSESEGRAEA

SEQ ID NO: 1599 - protein, 668 aa, Corylus avellana (Hazelnut)
MAGSWRARGSLVVLAILLFGCLFAISIAKEEATKLGTVIGIDLGTTYSCVGVYKNGHVEIIANDQGNRITPSWVGFTDGERLIGEAAKNQAAVNPERTIFDVKRLIGRKFEDKEVQKDMKLVPYKIVNKDGKPYIQVKIKDGETKVFSPEEISAMILIKMKETAEAFLGKKIKDAVVTVPAYFNDAQRQATKDAGIIAGLNVARIINEPTAAAIAYGLDKKGGEKNILVFDLGGGTFDVSILTIDNGVFEVLSTNGDTHLGGEDFDMRIMEYFIKLIKKKHGKDISKDNRAIGKLRREAERAKRALSSQHQVRVEIESLFDGVDFSEPLTRARFEELNNDFVQKDHGTREEAMEDAGLAKNQIDEIVLVGGSTRIPKVQQLLKDYFDGKEPNKGVNPDEAVAYGAAVQGSILSGEGGEETKDILLLDVAPLTLGIETVGGVMTKLIPRNTVIPTKKSQVFTTYQDQQTTVSIQVFEGERSLTKDCRNLGKFDLTGVPPAPRGTPQIEVTFEVDANGILNVKAEDKGTGKSEKITITNDKGRLSQEEIDRMVQEAEEFAEEDKKVKERIDARNTLETYVYNMKNQVNDKDKLADKLESDEKDKIESAVKDALEWLDDNQSAEKEDYDEKLKEVEAVCNPIITAVYQRSGGAPGGGSGEEDEDSESHDEL

SEQ ID NO: 1600 - protein, 448 aa, Corylus avellana (Hazelnut)
MLPKEDPELKKCKHKCRDERQFDEQQRRDGKQICEEKARERQQEEGNSSEESYGKEQEENPYVFQDEHFESRVKTEEGRVQVLENFTKRSRLLSGIENFRLAILEANPHTFISPAHFDAELVLFVAKGRATITMVREEKRESFNVEHGDIIRIPAGTPVYMINRDENEKLFIVKILQPVSAPGHFEAFYGAGGEDPESFYRAFSWEVLEAALKVRREQLEKVFGEQSKGSIVKASREKIRALSQHEEGPPRIWPFGGESSGPINLLHKHPSQSNQFGRLYEAHPDDHKQLQDLDLMVSFANITKGSMAGPYYNSRATKISVVVEGEGFFEMACPHLSSSSGSYQKISARLRRGVVFVAPAGHPVAVIASQNNNLQVLCFEVNAHGNSRFPLAGKGNIVNEFERDAKELAFNLPSREVERIFKNQDQAFFFPGPNKQQEEGGRGGRAFE

SEQ ID NO: 1601 - protein, 159 aa, Corylus avellana (Hazelnut)
MADRPQQLQVHPQRGHGHYEGGIKNQRGGGPSAVKVMAVLAALPVGGTLLALAGLTLAGSVIGLLVTSPLFIIFSPVLVPAAIVVGLAVASFLSSGALGLTGLSSLSWVLNYLRCASQSLPREMDQAKRRMQDMAAFVGQKTREVGQEIQSRAQEGRRT

SEQ ID NO: 1602 - protein, 140 aa, Corylus avellana (Hazelnut)
MAEHPRQLQDPAHQPRSHQVVKAATAATAGGSLLVPSGLILAGTVIALTLATPLFVIFSPVLVPAVITVSLIIMGFLASGGFGVAAVTVLSWIYRYVTGRHPPGADQLDHARMKLASKAREMKDRAEQFGQQHVTGSQGS

SEQ ID NO: 1603 - protein, 147 aa, Corylus avellana (Hazelnut)
MARLATLAALFAALLLVAHAAAFRTTITTVDVDEDIVNQQGRRGESCREQAQRQQNLNQCQRYMRQQSQYGSYDGSNQQQQQELEQCCQQLRQMDERCRCEGLRQAVMQQQGEMRGEEMREVMETARDLPNQCRLSPQRCEIRSARF

SEQ ID NO: 1604 - protein, 731 aa, Cucumis melo (Muskmelon)
MSSSLIFKLFFFSLFFSNRLASRLDSDDDGKNIYIVYMGRKLEDPDSAHLHHRAMLEQVVGSTFAPESVLHTYKRSFNGFAVKLTEEEAEKIASMEGVVSVFLNEMNELHTTRSWDFLGFPLTVPRRSQVESNIVVGVLDTGIWPESPSFDDEGFSPPPPKWKGTCETSNNFRCNRKIIGARSYHIGRPISPGDVNGPRDTNGHGTHTASTAAGGLVSQANLYGLGLGTARGGVPLARIAAYKVCWNDGCSDTDILAAYDDAIADGVDIISLSVGGANPRHYFVDAIAIGSFHAVERGILTSNSAGNGGPNFFTTASLSPWLLSVAASTMDRKFVTQVQIGNGQSFQGVSINTFDNQYYPLVSGRDIPNTGFDKSTSRFCTDKSVNPNLLKGKIVVCEASFGPHEFFKSLDGAAGVLMTSNTRDYADSYPLPSSVLDPNDLLATLRYIYSIRSPGATIFKSTTILNASAPVVVSFSSRGPNRATKDVIKPDISGPGVEILAAWPSVAPVGGIRRNTLFNIISGTSMSCPHITGIATYVKTYNPTWSPAAIKSALMTTASPMNARFNPQAEFAYGSGHVNPLKAVRPGLVYDANESDYVKFLCGQGYNTQAVRRITGDYSACTSGNTGRVWDLNYPSFGLSVSPSQTFNQYFNRTLTSVAPQASTYRAMISAPQGLTISVNPNVLSFNGLGDRKSFTLTVRGSIKGFVVSASLVWSDGVHYVRSPITITSLV

SEQ ID NO: 1605 - protein, 131 aa, Cucumis melo (Muskmelon)
MSWQVYVDEHLMCEIEGNHLTSAAIIGQDGSVWAQSQNFPQLKPEEVAGIVGDFADPGTLAPTGLYIGGTKYMVIQGEPGAVIRGKKGPGGATVKKTGMALVIGIYDEPMTPGQCNMIVERLGDYLIDQGL

SEQ ID NO: 1606 - protein, 41 aa, Cucumis melo (Muskmelon)
DFVDAHNAARAQVGVGPVHWTVDAYARQYANDRNLVHSATR

SEQ ID NO: 1607 - protein, 154 aa, Daucus carota (Carrot)
MGAQSHSLEITSSVSAEKIFSGIVLDVDTVIPKAAPGAYKSVEVKGDGGAGTVRIITLPEGSPITSMTVRTDAVNKEALTYDSTVIDGDILLGFIESIETHLVVVPTADGGSITKTTAIFHTKGDAVVPEENIKFADAQNTALFKAIEAYLIAN

SEQ ID NO: 1608 - protein, 154 aa, Daucus carota (Carrot)
MGVQKTEVEAPSTVSAEKMYQGFLLDMDTVFPKVLPQLIKSVEILEGDGGVGTVRLVHLGEATEYTTMKQKVDVIDKAGLGYTYTTIGGDILVEGLESVVNQFVVVPTDGGCIVKNTTIYNTKGDAVLPEDKVKEATEKSALAFKAVEAYLLAN

SEQ ID NO: 1609 - protein, 154 aa, Daucus carota (Carrot)
MGVQKHEQEITSSVPAEKMFHGLILDIDNILPKAAPGAYKNVEIKGDGGVGTIKHITLPDGGPVTTMTLRTDGLDKKGFTIDYSVIDGDVLMGFIDKIENHLSVVPTADGGSTTKTTAIFHTKGDAVVPEENIKYAEAQNTMLFKAVEAYLIAN

SEQ ID NO: 1610 - protein, 134 aa, Daucus carota (Carrot)
MSWQTYVDDHLMCEVDGNPGQQLSAAAIIGHDGSVWAQSSTFPKFKPEEITGIMKNFDEPGHLAPTGLYLGGTKYMVIQGEPIAVIRGKKGSGGVTIKKTGQALVFGVYDEPVTPGQCNLIVERLGDYLIEQGL

SEQ ID NO: 1611 - protein, 306 aa, Daucus carota (Carrot)
MATKILIVGGTGYIGKFIVEASAKAGHPTFVLVREATLTSPDKSQLIDSFKSLGVTFVHGDLYDHGSLVKAIKQVDVVISTLGHGQLADQDKLLAAIVEAGNVKRFFPSEFGQDVDRVNAVEPAKSAFAAKAQFRRTVEAAGVPFTYVACDFFAGYFLPTLAQAGAAAPPRDKAVILGDGIPKVAFNKEEDIATYTIKAVDDPRTLNKILYVRPPHNTLSFNELLSVWEKKIGKTLEKIYVPEEQVLKSIQESPVPINVLLSISHSAFVKGDQTSFEVEPSFGVEASALYPDVKYTTVDEYLSQFV

SEQ ID NO: 1612 - protein, 149 aa, Fagopyrum esculentum (Common buckwheat)
MKLFIILATATLLIAATQATYPRDEGFDLGETQMSSKCMRQVKMNEPHLKKCNRYIAMDILDDKYAEALSRVEGEGCKSEESCMRGCCVAMKEMDDECVCEWMKMMVENQKGRIGERLIKEGVRDLKELPSKCGLSELECGSRGNRYFV

SEQ ID NO: 1613 - protein, 136 aa, Fagopyrum esculentum (Common buckwheat)
GDYPFEPRRQIEHCRQRCQDRSQGFRETRECLETCEKRAGFDDEPSKEVDSYTTDTRSRDPQQEFRQCRHRCQTQEEGGRQQRKCEQRCEKQLERQQGYDDEEFGQGRSNIGAPVRNYDDCTEMCGGSPLCALFCE

SEQ ID NO: 1614 - protein, 40 aa, Fagopyrum esculentum (Common buckwheat)
AQCGAQGGGATCPGGLCCSQWGWCGSTPKYCGAGCQSNCK

SEQ ID NO: 1615 - protein, 40 aa, Fagopyrum esculentum (Common buckwheat)
AQCGAQGGGATCPGGLCCSQWGWCGSTPKYCGAGCQSNCR

SEQ ID NO: 1616 - protein, 140 aa, Fagopyrum esculentum (Common buckwheat)
IAVVTNGKGKFQMACPHISAEGKQSKRQREGKSIVHYETVNGDLSSGTVFVVPAGHPFVTAASLEDNLELICFEVNADDNERIPLAGKNSLFKQFEREAKELAFEEKADVVDKLLEKQQQEFFFEGPRRRKEQEAGRSDA

SEQ ID NO: 1617 - protein, 149 aa, Fagopyrum tataricum (Tartarian buckwheat)
MKLFIILATATLLIAATQAKYLRDEGFDLGETQMSSKCTRQVKMMEPELVKCNRYIAMDIMDDKYEEALSRIQGEGCESEEKFLRGCCVAMKEMEDECVCEWMKMMVENQKGRIGETLMRKGIRDLKELPNKCGISEMECHSRGNWYYV

SEQ ID NO: 1618 - protein, 160 aa, Fagus sylvatica (European beech)
MGVFTYESETTTVITPARLFKAFVLDADNLIPKVAPQAIKSSEIIEGSGGPGTIKKITFGEGSQFNYVKHRIDEIDNANFTYACTLIEGDAISETLEKIAYEIKLVASPDGGSILKSTSKYHTKGDHEIKEDQIKAGKEEASGIFKAVEAYLLANPAAYH

SEQ ID NO: 1619 - protein, 160 aa, Fragaria ananassa (Strawberry)
MGVYTYENEFTSDIPAPKLFKAFVLDADNLIPKIAPQAVKCAEILEGDGGPGTIKKITFGEGSHYGYVKHKIHSIDKENHTYSYSLIEGDALSDNIEKIDYETKLVSAPHGGTVIKTTSKYHTKGDVEIKEEHVKAGKEKASHLFKLIEGYLKDHPSEYN

SEQ ID NO: 1620 - protein, 117 aa, Fragaria ananassa (Strawberry)
MASSTAMKLSLVALLCIVVALPIAQAITCGQVASNISPCLTYVKSGGAVPAACCSGIRNLNGMAKTTADRQAACNCLKQAAGGIKGLNPNLAAGLPGKCGVSVPYKISTTTNCAAVK

SEQ ID NO: 1621 - protein, 117 aa, Fragaria ananassa (Strawberry)
MASSTAMKLSLVALLCIVVALPIAQAITCGQVASNISPCVTYVKSGGAVPAPCCSGIRNLNGMAKTTADRQATCNCLKQAAGGIKGLNPNLAAGLPGKCGVSVPYKISTTTNCAAVK

SEQ ID NO: 1622 - protein, 117 aa, Fragaria ananassa (Strawberry)
MASSTAMKLSLVALLCIVVALPIAQAITCGQVASSISPCVNYVKSGGAVPAACCNGIRSLNSAAKTTADRQATCNCLKQASGAIKGLNPSLAAGLPGKCGVSVPYKISTSTNCAAVK

SEQ ID NO: 1623 - protein, 117 aa, Fragaria ananassa (Strawberry)
MAISTAMKLSLVALLCIVVALPIAQAITCGQVASSISPCVNYVKSGGAVPAACCNGIRSLNSAAKTTADRQTTCNCLKQASGAIKGLNPNLAAGLPGKCGVNVPYKISTSTNCAAVK

SEQ ID NO: 1624 - protein, 131 aa, Fragaria ananassa (Strawberry)
MSWQTYVDDHLMCEIEGNHLSAAAIIGQDGSVWAQSATFPQLKPEEVTGIVRDFDEPGTLAPTGLYLGGTKYMVIQGEPGAVIRGKKGPGGVTVKKTTLALLIGIYDEPMTPGQCNMIVERLGDYLVEQGL

SEQ ID NO: 1625 - protein, 145 aa, Fraxinus excelsior (Ash)
EDVPQPPVSLFYVQGQVYCDTCRAGFITELSEFIQGAGVRLQCKDKENGKVTFTEVGYTRAEGLYSMVIERDHKNEFCEIVLLSSSRKDCDEIPTEGWVKPSLKFILNTVNGTTRTINPLGFFKKEVLPKCPQVYNKLGMYPPNM

SEQ ID NO: 1626 - protein, 145 aa, Fraxinus excelsior (Ash)
EDVPQPPVSLFYVQGQVYCDTCRAGFITELSEFIQGAGVRLQCKEKENGKVTFTEVGYTRAEGLYSMVIERDHKNEFCEIVLLSSSRKDCHEIPTEGWVKPSLKFILNTVNGTTRTINPLGFFKKEALPKCPQVYNKLGMYPPNM

SEQ ID NO: 1627 - protein, 146 aa, Fraxinus excelsior (Ash)
MEDVPQPPVSQFHIQGQVYCDTCRARFITKLSEFITGASVRLQCRDKENGDVTFTEIGYTRGEGLYSMFVERDHKNEFCEITLLSSGRKDCNEIPIEGWVKPSLKFILNTVNGTTRTINPLGFFKKEALPQCAQVYNKLGMYPPNM

SEQ ID NO: 1628 - protein, 42 aa, Glycine max (Soybean)
  misc_feature (8)..(8): Xaa can be any naturally occurring amino acid
  misc_feature (14)..(14): Xaa can be any naturally occurring amino acid
  misc_feature (28)..(29): Xaa can be any naturally occurring amino acid
  misc_feature (36)..(36): Xaa can be any naturally occurring amino acid
  misc_feature (38)..(39): Xaa can be any naturally occurring amino acid
ALITRPSXPDLSIXLNILGGSLGTVDDXXALIGGLXDXXAIV

SEQ ID NO: 1629 - protein, 131 aa, Glycine max (Soybean)
MSWQAYVDDHLLCDIEGNHLTHAAIIGQDGSVWAQSTDFPQFKPEEITAIMNDFNEPGSLAPTGLYLGGTKYMVIQGEPGAVIRGKKGPGGVTVKKTGAALIIGIYDEPMTPGQCNMVVERPGDYLIDQGY

SEQ ID NO: 1630 - protein, 131 aa, Glycine max (Soybean)
MSWQAYVDDHLLCGIEGNHLTHAAIIGQDGSVWLQSTDFPQFKPEEITAIMNDFNEPGSLAPTGLYLGGTKYMVIQGEPGAVIRGKKGPGGVTVKKTGAALIIGIYDEPMTPGQCNMVVERLGDYLIDQGY

SEQ ID NO: 1631 - protein, 158 aa, Glycine max (Soybean)
MGVFTFEDEINSPVAPATLYKALVTDADNVIPKALDSFKSVENVEGNGGPGTIKKITFLEDGETKFVLHKIESIDEANLGYSYSVVGGAALPDTAEKITFDSKLVAGPNGGSAGKLTVKYETKGDAEPNQDELKTGKAKADALFKAIEAYLLAHPDYN

SEQ ID NO: 1632 - protein, 543 aa, Glycine max (Soybean)
VEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFY

SEQ ID NO: 1633 - protein, 559 aa, Glycine max (Soybean)
VEEEEECEEGQIPRPRPQHPERERQQHGEKEEDEGEQPRPFPFPRPRQPHQEEEHEQKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFY

SEQ ID NO: 1634 - protein, 439 aa, Glycine max (Soybean)
MMRVRFPLLVLLGTVFLASVCVSLKVREDENNPFYFRSSNSFQTLFENQNVRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALY

SEQ ID NO: 1635 - protein, 495 aa, Glycine max (Soybean)
MAKLVFSLCFLLFSGCCFAFSSREQPQQNECQIQKLNALKPDNRIESEGGLIETWNPNNKPFQCAGVALSRCTLNRNALRRPSYTNGPQEIYIQQGKGIFGMIYPGCPSTFEEPQQPQQRGQSSRPQDRHQKIYNFREGDLIAVPTGVAWWMYNNEDTPVVAVSIIDTNSLENQLDQMPRRFYLAGNQEQEFLKYQQEQGGHQSQKGKHQQEEENEGGSILSGFTLEFLEHAFSVDKQIAKNLQGENEGEDKGAIVTVKGGLSVIKPPTDEQQQRPQEEEEEEEDEKPQCKGKDKHCQRPRGSQSKSRRNGIDETICTMRLRHNIGQTSSPDIYNPQAGSVTTATSLDFPALSWLRLSAEFGSLRKNAMFVPHYNLNANSIIYALNGRALIQVVNCNGERVFDGELQEGRVLIVPQNFVVAARSQSDNFEYVSFKTNDTPMIGTLAGANSLLNALPEEVIQHTFNLKSQQARQIKNNNPFKFLVPPQESQKRAVA

SEQ ID NO: 1636 - protein, 485 aa, Glycine max (Soybean)
MAKLVLSLCFLLFSGCFALREQAQQNECQIQKLNALKPDNRIESEGGFIETWNPNNKPFQCAGVALSRCTLNRNALRRPSYTNGPQEIYIQQGNGIFGMIFPGCPSTYQEPQESQQRGRSQRPQDRHQKVHRFREGDLIAVPTGVAWWMYNNEDTPVVAVSIIDTNSLENQLDQMPRRFYLAGNQEQEFLKYQQQQQGGSQSQKGKQQEEENEGSNILSGFAPEFLKEAFGVNMQIVRNLQGENEEEDSGAIVTVKGGLRVTAPAMRKPQQEEDDDDEEEQPQCVETDKGCQRQSKRSRNGIDETICTMRLRQNIGQNSSPDIYNPQAGSITTATSLDFPALWLLKLSAQYGSLRKNAMFVPHYTLNANSIIYALNGRALVQVVNCNGERVFDGELQEGGVLIVPQNFAVAAKSQSDNFEYVSFKTNDRPSIGNLAGANSLLNALPEEVIQHTFNLKSQQARQVKNNNPFSFLVPPQESQRRAVA

SEQ ID NO: 1637 - protein, 481 aa, Glycine max (Soybean)
MAKLVLSLCFLLFSGCCFAFSFREQPQQNECQIQRLNALKPDNRIESEGGFIETWNPNNKPFQCAGVALSRCTLNRNALRRPSYTNAPQEIYIQQGSGIFGMIFPGCPSTFEEPQQKGQSSRPQDRHQKIYHFREGDLIAVPTGFAYWMYNNEDTPVVAVSLIDTNSFQNQLDQMPRRFYLAGNQEQEFLQYQPQKQQGGTQSQKGKRQQEEENEGGSILSGFAPEFLEHAFVVDRQIVRKLQGENEEEEKGAIVTVKGGLSVISPPTEEQQQRPEEEEKPDCDEKDKHCQSQSRNGIDETICTMRLRHNIGQTSSPDIFNPQAGSITTATSLDFPALSWLKLSAQFGSLRKNAMFVPHYNLNANSIIYALNGRALVQVVNCNGERVFDGELQEGQVLIVPQNFAVAARSQSDNFEYVSFKTNDRPSIGNLAGANSLLNALPEEVIQQTFNLRRQQARQVKNNNPFSFLVPPKESQRRVVA

SEQ ID NO: 1638 - protein, 563 aa, Glycine max (Soybean)
MGKPFTLSLSSLCLLLLSSACFAISSSKLNECQLNNLNALEPDHRVESEGGLIQTWNSQHPELKCAGVTVSKLTLNRNGLHLPSYSPYPRMIIIAQGKGALGVAIPGCPETFEEPQEQSNRRGSRSQKQQLQDSHQKIRHFNEGDVLVIPPGVPYWTYNTGDEPVVAISLLDTSNFNNQLDQTPRVFYLAGNPDIEYPETMQQQQQQKSHGGRKQGQHQQEEEEEGGSVLSGFSKHFLAQSFNTNEDIAEKLQSPDDERKQIVTVEGGLSVISPKWQEQQDEDEDEDEDDEDEQIPSHPPRRPSHGKREQDEDEDEDEDKPRPSRPSQGKREQDQDQDEDEDEDEDQPRKSREWRSKKTQPRRPRQEEPRERGCETRNGVEENICTLKLHENIARPSRADFYNPKAGRISTLNSLTLPALRQFQLSAQYVVLYKNGIYSPHWNLNANSVIYVTRGQGKVRVVNCQGNAVFDGELRRGQLLVVPQNFVVAEQAGEQGFEYIVFKTHHNAVTSYLKDVFRAIPSEVLAHSYNLRQSQVSELKYEGNWGPLVNPESQQGSPRVKVA

SEQ ID NO: 1639 - protein, 517 aa, Glycine max (Soybean)
MGKPFFTLSLSSLCLLLLSSACFAITSSKFNECQLNNLNALEPDHRVESEGGLIETWNSQHPELQCAGVTVSKRTLNRNGLHLPSYSPYPQMIIVVQGKGAIGFAFPGCPETFEKPQQQSSRRGSRSQQQLQDSHQKIRHFNEGDVLVIPPGVPYWTYNTGDEPVVAISLLDTSNFNNQLDQNPRVFYLAGNPDIEHPETMQQQQQQKSHGGRKQGQHQQQEEEGGSVLSGFSKHFLAQSFNTNEDTAEKLRSPDDERKQIVTVEGGLSVISPKWQEQEDEDEDEDEEYEQTPSYPPRRPSHGKHEDDEDEDEEEDQPRPDHPPQRPSRPEQQEPRGRGCQTRNGVEENICTMKLHENIARPSRADFYNPKAGRISTLNSLTLPALRQFGLSAQYVVLYRNGIYSPHWNLNANSVIYVTRGKGRVRVVNCQGNAVFDGELRRGQLLVVPQNFVVAEQGGEQGLEYVVFKTHHNAVSSYIKDVFRAIPSEVLSNSYNLGQSQVRQLKYQGNSGPLVNP

SEQ ID NO: 1640 - protein, 643 aa, Glycine max (Soybean)
MASEQLARRENTTTEKEIHVEKHRVPKMATHFEHLAEQAKESDITAGKDTPQGSIEALQAGERVKDHAGKAMGDIGGRGKARETHELGAHFESLADKVTDHAAANVVGNKESQREARGGVRDVGKFEMRTEGGEKGNKDRPELKTRTREVIGRTEKERGRESGGQVVAEKGRETETARGRVGAENEGARTTAVITCTLEKGGGTQKPIREEERESESERSAWEQISNYSDQATQGVKEKYERAKQAASETLNTTTQTAQEKSAQAKNLAAQAKDATLEKGQQGYAVTKDTISSAAKTASEKTAPVAEKAKDYTLQAAEKAKSAGGTTASYVGEKAVQAKDVAVESGKSAAGYAAKVAADLRDKATAVGWAAAHFSAEKTVEGTKAAAHVVEGAAGYAGHKAAELASMSAGAVKGLAASAGETAKEYTAKKKEEAQRELEAKKPSQPQEAEERPSEGIGETVRQYAQKPKPSERNPQKEGTGSIVFTAIGETVSSAGEKVKKPFKNTTGGESEGGGGKEEGKSVIGKSLTSIGEKLGDAKQREELLDNVTGNITEGGGEVLGAVGETVAEIGQNMMKPAEIVQERAHVRQAGGVLDAIGETIAEIAETTRVMVSGEDERVLRQSVVLETRVTGRAKHEEGSHGA

SEQ ID NO: 1641 - protein, 158 aa, Glycine max (Soybean)
MTKFTILLISLLFCIAHTCSASKWQHQQDSCRKQLQGVNLTPCEKHIMEKIQGRGDDDDDDDDDNHILRTMRGRINYIRRNEGKDEDEEEEGHMQKCCTEMSELRSPKCQCKALQKIMENQSEELEEKQKKKMEKELINLATMCRFGPMIQCDLSSDD

SEQ ID NO: 1642 - protein, 133 aa, Helianthus annuus (Sunflower)
MSWQAYVDEHLMCDIEGTGQHLTSAAILGLDGTVWAQSAKFPQFKPEEMKGIIKEFDEAGTLAPTGMFIAGAKYMVLQGEPGAVIRGKKGAGGICIKKTGQAMIMGIYDEPVAPGQCNMVVERLGDYLLEQGM

SEQ ID NO: 1643 - protein, 116 aa, Helianthus annuus (Sunflower)
MKGTSMGVAILAMIVMAQLMVHPSVAITCNDVTGNLTPCLPYLRSGGKPTPACCAGAKKLLGATRTQADRRTACKCAKTAAPQLKVRPDMASSLPGKCGISTSIPINPNVNCNTIP

SEQ ID NO: 1644 - protein, 138 aa, Hevea brasiliensis (Para rubber tree (latex))
MAEDEDNQQGQGEGLKYLGFVQDAATYAVTTFSNVYLFAKDKSGPLQPGVDIIEGPVKNVAVPLYNRFSYIPNGALKFVDSTVVASVTIIDRSLPPIVKDASIQVVSAIRAAPEAARSLASSLPGQTKILAKVFYGEN

SEQ ID NO: 1645 - protein, 374 aa, Hevea brasiliensis (Para rubber tree (latex))
MAISSSTSGTSSSFPSRTTVMLLLFFFAASVGITDAQVGVCYGMQGNNLPPVSEVIALYKKSNITRMRIYDPNRAVLEALRGSNIELILGVPNSDLQSLTNPSNAKSWVQKNVRGFWSSVLFRYIAVGNEISPVNRGTAWLAQFVLPAMRNIHDAIRSAGLQDQIKVSTAIDLTLVGNSYPPSAGAFRDDVRSYLDPIIGFLSSIRSPLLANIYPYFTYAYNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPNKWQKYNLNFSAEKNWDISTEHNATILFLKSDM

SEQ ID NO: 1646 - protein, 204 aa, Hevea brasiliensis (Para rubber tree (latex))
MAEEVEEERLKYLDFVRAAGVYAVDSFSTLYLYAKDISGPLKPGVDTIENVVKTVVTPVYYIPLEAVKFVDKTVDVSVTSLDGVVPPVIKQVSAQTYSVAQDAPRIVLDVASSVFNTGVQEGAKALYANLEPKAEQYAVITWRALNKLPLVPQVANVVVPTAVYFSEKYNDVVRGTTEQGYRVSSYLPLLPTEKITKVFGDEAS

SEQ ID NO: 1647 - protein, 366 aa, Hevea brasiliensis (Para rubber tree (latex))
MASLAYSLFILSLFTFTLLNPVCTELDEYLFSFGDGLYDAGNAKFIYPDKYLPSYHHPYGTTFFDYPTGRFSDGRTVVDFVAENVSLPRIPPFKNKEANFTYGANFASEGATASDSNPLIDFRSQIRDFGELKLEWAVQLVNVTELARRLKKAVYLISFGADDYLNYEIPSEASREQLESIVDVVLGNISDRIKELYDFGARKFVVENVAPLGLIPFIKQTSDNSTLFYELASLHAMKLPQILEKIQDGYLFPEFNYTVFNYFGIIKEIIDAPGEHGFKYGDIACCGNSTYRGQACGFLDYEFCVCGNKTEYLFFDGTHNTDAANNLLAELMWDKESGFISPYGVKDFFPSPTTIQTLLTEATALG

SEQ ID NO: 1648 - protein, 151 aa, Hevea brasiliensis (Para rubber tree (latex))
MASVEVESAATALPKNETPEVTKAEETKTEEPAAPPASEQETADATPEKEEPTAAPAEPEAPAPETEKAEEVEKIEKTEEPAPEADQTTPEEKPAEPEPVAEEEPKHETKETETEAPAAPAEGEKPAEEEKPITEAAETATTEVPVEKTEE

SEQ ID NO: 1649 - protein, 204 aa, Hevea brasiliensis (Para rubber tree (latex))
MNIFIVVLLCLTGVAIAEQCGRQAGGKLCPNNLCCSQWGWCGSTDEYCSPDHNCQSNCKDSGEGVGGGSASNVLATYHLYNSQDHGWDLNAASAYCSTWDANKPYSWRSKYGWTAFCGPVGAHGQSSCGKCLSVTNTGTGAKTTVRIVDQCSNGGLDLDVNVFRQLDTDGKGYERGHITVNYQFVDCGDSFNPLFSVMKSSVIN

SEQ ID NO: 1650 - protein, 388 aa, Hevea brasiliensis (Para rubber tree (latex))
MATGSTTLTQGKKITVLSIDGGGIRGIIPGIILASLESKLQDLDGPDARIADYFDIIAGTSTGGLITTMLTAPNEDKKPMYQAKDIKDFYLENCPKIFPKESRDNYDPIHSIGPIYDGEYLRELCNNLLKDLTVKDTSTDVIIPTFDIKLLLPVIFPSDDAKCNALKNARLADVCISTSAAPVLLPAHSFTTEDDKNIHTFELIDGGVAATNPTLLALTHIRNEIIRQNPRFIGANLTESKSRLVLSLGTGKSEYKEKYNADMTSKWRLYNWALYNGNSPAVDIFSNASSDMVDSHLSALFKSLDCEDYYLRIQDDTLTGEESSGHIATEENLQRLVEIGTELLEKQESRINLDTGRLESIPGAPTNEAAIAKFAKLLSEERKLRQLK

SEQ ID NO: 1651 - protein, 131 aa, Hevea brasiliensis (Para rubber tree (latex))
MSWQTYVDERLMCEIEGNHLTAAAIIGQDGSVWAQSSNFPQFKSEEITAIMSDFDEPGTLAPTGLHLGGTKYMVIQGEAGAVIRGKKGPGGVTVRKTNQALIIGIYDEPMTPGQCNMIVERLGDYLLEQGM

SEQ ID NO: 1652 - protein, 131 aa, Hevea brasiliensis (Para rubber tree (latex))
MSWQAYVDDHLMCEIEGNHLSAAAIIGQDGSVWAQSANFPQFKSEEITGIMSDFHEPGTLAPTGLYIGGTKYMVIQGEPGAVIRGKKGPGGVTVKKTNQALIIGIYDEPMTPGQCNMIVERLGDYLIDQGY

SEQ ID NO: 1653 - protein, 131 aa, Hevea brasiliensis (Para rubber tree (latex))
MSWQTYVDEHLMCDIDGHHLTAAAIIGHDGSVWAQSSSFPQFKPEEVAAIMKDFDEPGSLAPTGLHLGGTKYMVIQGEPGAVIRGKKGSGGITVKKTGQALIIGIYDEPLTPGQCNMIVERLGDYLLEQGM

SEQ ID NO: 1654 - protein, 131 aa, Hevea brasiliensis (Para rubber tree (latex))
MSWQTYVDDHLMCDIDGHRLTAAAIIGHDGSVWAQSSSFPQFKSDEVAAIMKDFDEPGSLAPTGLHLGSTKYMVIQGEPGAVIRGKKGSGGITVKKTSQALIIGIYDEPLTPGQCNMIVERLGDYLLEQGM

SEQ ID NO: 1655 - protein, 131 aa, Hevea brasiliensis (Para rubber tree (latex))
MSWQTYVDDHLMCDIDGHRLTAAAIIGHDGSVWAQSSGFPQFKSDEVAAVMKDFDEPGSLAPTGLHLGGTKYMVIQGEPGAVIRGKKGSGGITVKKTGQALIIGIYDEPLTPGQCNMIVERLGDYLLEQGM

SEQ ID NO: 1656 - protein, 131 aa, Hevea brasiliensis (Para rubber tree (latex))
MSWQTYVDDHLMCDIDGHRLTAAAIIGHDGSVWAQSSSFPQFKSDEVAAVMKDFDEPGSLAPTGLHLGGTKYMVIQGEPGAVIRGKKGSGGITVKKTGQALIIGIYDEPLTPGQCNMIVERLGDYLLDQGL

SEQ ID NO: 1657 - protein, 445 aa, Hevea brasiliensis (Para rubber tree (latex)) [sequence omitted]

SEQ ID NO: 1658 - protein, 233 aa, Hevea brasiliensis (Para rubber tree (latex))
MALRSLVTRKNLPSAFKAATGLGQLRGLQTFSLPDLPYDYGALEPAISGEIMQLHHQKHHQTYITNYNKALEQLNDAIEKGDSAAVVKLQSAIKFNGGGHVNHSIFWKNLAPVREGGGELPHGSLGWAIDADFGSLEKLIQLMNAEGAALQGSGWVWLALDKELKKLVVETTANQDPLVTKGPTLVPLLGIDVWEHAYYLQYKNVRPDYLKNIWKVMNWKYASEVYAKECPSS

SEQ ID NO: 1659 - protein, 205 aa, Hevea brasiliensis (Para rubber tree (latex))
QTFSLPDLPYDYGALEPAISGEIMQLHHQKHHQTYITNYNKALEQLNDAIEKGDSAAVVKLQSAIKFNGGGHVNHSIFWKNLAPVREGGGELPHGSLGWAIDADFGSLEKLIQLMNAEGVALQGSGWVWLALDKELKKLVVETTANQDPLVTKGPTLVPLLGIDVWEHAYYLQYKNVRPDYLKNIWKVMNWKYASEVYAKECPSS

SEQ ID NO: 1660 - protein, 205 aa, Hevea brasiliensis (Para rubber tree (latex))
QTFSLPDLPYDYGALEPAISGEIMQLHHQKHHQTYITNYNKALEQLNDAIEKGDSAAVVKLQSAIKFNGGGHVNHSIFWKNLAPVREGGGELPHGSLGWAIDADFGSLEKLIQLMNAEGAALRGSGWVWLALDKELKKLVVETTANQDPLVTKGPTLVPLLGIDVWEHAYYLQYKNVRPDYLKNIWKVMNWKYASEVYAKECPSS

SEQ ID NO: 1661 - protein, 295 aa, Hevea brasiliensis (Para rubber tree (latex))
EQCGRQAGGALCPGGLCCSQYGWCANTPEYCGSGCQSQCDGGGGGEDGGIDLGSIISRSTFEEMLKHRNDAACPAKGFYTYDAFISAAKAFPAFGTTGDVDTCKREIAAFFGQTSHATTGGWPTAPDGPYAWGYCYKEELNQASSYCSPSPAYPCAPGKKYYGRGPIQLSWNYNYGQCGQALGLDLLNNPDLVATDRVISFKAAIWFWMTPQFPKPSCHDVITGQWSPTGHDISAGRAPGYGVITNIINGGLECGRGWDARVEDRIGFYKRYCDMFAVGYGSNLDCYNQTPFGLG

SEQ ID NO: 1662 - protein, 295 aa, Hevea brasiliensis (Para rubber tree (latex))
EQCGRQAGGALCPGGLCCSQYGWCANTPEYCGSGCQSQCDGGVGGEGGCVDLGSIISRSTFEEMLKHRNNAACPAKGFYTYDAFISAAKAFPAFGTTGDVDTCKREIAAFFGQTSHATTGGWPTAPDGPYAWGYCHKEELNQASSYCSPSPAYPCAPGKKYYGRGPIQLSWNYNYGQCGQALGLDLLNNPDLVATDRVISFKAAIWFWMTPQFPKPSCHDVITGQWSPTGHDISAGRAPGYGVITNIINGGLECGSGWDARVEDRIGFYKRYCDMFGVGYGSNLDCYNQTPFGLG

SEQ ID NO: 1663 - protein, 116 aa, Hevea brasiliensis (Para rubber tree (latex))
MAALKMVSFLVLCMLVAAPMTAQAITCGQVQSALVPCLSYLKTTGPTPPATCCNGVRTINNAAKTTADRRTACQCLKSAAGSVKGLNPTTVAGLPGKCGVNIPYKISLSTNCATVK

SEQ ID NO: 1664 - protein, 391 aa, Hevea brasiliensis (Para rubber tree (latex))
MEFPETNNNPIITLSFLLCMLSLAYASETCDFPAIFNFGDSNSDTGGKAAAFYPLNPPYGETFFHRSTGRYSDGRLIIDFIAESFNLPYLSPYLSSLGSNFKHGADFATAGSTIKLPTTIIPAHGGFSPFYLDVQYSQFRQFIPRSQFIRETGGIFAELVPEEYYFEKALYTFDIGQNDLTEGFLNLTVEEVNATVPDLVNSFSANVKKIYDLGARTFWIHNTGPIGCLSFILTYFPWAEKDSAGCAKAYNEVAQHFNHKLKEIVAQLRKDLPLATFVHVDIYSVKYSLFSEPEKHGFEFPLITCCGYGGKYNFSVTAPCGDTVTADDGTKIVVGSCACPSVRVNWDGAHYTEAANEYFFDQISTGAFSDPPVPLNMACHKTESLRTLASV

SEQ ID NO: 1665 - protein, 208 aa, Hevea brasiliensis (Para rubber tree (latex))
GGIVIYWGQNGNEGTLTQTCSTRKYSYVNIAFLNKFGNGQTPQINLAGHCNPAAGGCTIVSNGIRSCQIQGIKVMLSLGGGIGSYTLASQADAKNVADYLWSNFLGGKSSSRPLGDAVLDGIDFDIEHGSTLYWDDLARYLSAYSKQGKKVYLTAAPQCPFPDRYLGTALNTGLLTMYGFNSITIHHASIAQVTLTTSLTRGIDGPHL

SEQ ID NO: 1666 - protein, 70 aa, Hevea brasiliensis (Para rubber tree (latex))
MASQCPVKDAWPELIGTNGDIAAGIIETENANVKAIVLKKGSPMTMEYNLCRVLVFVDDNRVVTQAPAIG

SEQ ID NO: 1667 - protein, 155 aa, Humulus japonicus (Japanese hop)
MKNLQHHNKIITFKTPDDSTTLELNSHISLPYHWEQCLDLKTGEIYYINWRNGMKAKEDPRTTITEYNSNGSNGDYYYSEEDSSYDSEESSSESSPPPATTSRESQYRGAEKDHVLVVGGCKSCFMYFMVPKQVQECPKCCGQPLHFDRSQSGSQ

SEQ ID NO: 1668 - protein, 161 aa, Juglans nigra (Black walnut)
RHEARKCIFHTFSLTMARLATLAALLVALLFVANAAAFRTTITTMEIDEDIDNPRRRGEGCQEQIQRQQNLNHCQYYLRQQSRSGGYDEDNQRQHFRQCCQQLSQIEEQCQCEGLRQAVRRQQQQQGLRGEEMEEMVQSARDLPKECGISSQRCEIRRSWF

SEQ ID NO: 1669 - protein, 481 aa, Juglans nigra (Black walnut)
GRDRQDPQQQYHRCQRRCQIQEQSPERQRQCQQRCERQYKEQQGRERGPEASPRRESKGREEEQQRHNPYYFHSQSIRSRHESEEGEVKYLERFAERTELLRGIENYRVVILDANPNTFMLPHHKDAESVIVVTRGRATLTLVSQETRESFNLECGDVIRVPAGATEYVINQDSNERLEMVKLLQPVNNPGQVREYYAAGAKSPDQSYLRVFSNDILVAALNTPRDRLERFFDQQEQREGVIIRASQEKLRALSQHAMSAGQRPWGRRSSGGPISLKSERPSYSNQFGQFFEACPEEHRQLQEMDVLVNYAEIKRGAMMVPHYNSKATVVVYVVEGTGRYEMACPHVSSQSFEDQGRREQEEEESTGRFQKVTARLARGDIFVIPAGHPIAITASQNENLRLLGFGINGENNQRNFLAGQNSIINQLEREAKELSFNMPREEIEEIFESQMESYFVPTERQSRRGQGRDHPLASILGFAFF

SEQ ID NO: 1670 - protein, 139 aa, Juglans regia (English walnut)
AALLVALLFVANAAAFRTTITTMEIDEDIDNPRRRGEGCREQIQRQQNLNHCQYYLRQQSRSGGYDEDNQRQHFRQCCQQLSQMDEQCQCEGLRQVVRRQQQQQGLRGEEMEEMVQSARDLPNECGISSQRCEIRRSWF

SEQ ID NO: 1671 - protein, 593 aa, Juglans regia (English walnut)
RGRDDDDEENPRDPREQYRQCQEYCRRQGQGQRQQQQCQIRCEERLEEDQRSQEERERRRGRDVDDQNPRDPEQRYEQCQQQCERQRRGQEQTLCRRRCEQRRQQEERERQRGRDRQDPQQQYHRCQRRCQIQEQSPERQRQCQQRCERQYKEQQGRERGPEASPRRESRGREEEQQRHNPYYFHSQSIRSRHESEEGEVKYLERFTERTELLRGIENYRVVILDANPNTSMLPHHKDAESVAVVTRGRATLTLVSQETRESFNLECGDVIRVPAGATVYVINQDSNERLEMVKLLQPVNNPGQFREYYAAGAKSPDQSYLRVFSNDILVAALNTPRDRLERFFDQQEQREGVIIRASQEKLRALSQHAMSAGQRPWGRRSSGGPISLKSESPSYSNQFGQFFEACPEEHRQLQEMDVLVNYAEIKRGAMMVPHYNSKATVVVYVVEGTGRYEMACPHVSSQSYEGQGRREQEEEESTGRFQKVTARLARGDIFVIPAGHPIAITASQNENLRLLGFDINGENNQRDFLAGQNNIINQLEREAKELSFNMPREEIEEIFESQMESYFVPTERQSRRGQGRDHPLASILDFAFF

SEQ ID NO: 1672 - protein, 119 aa, Juglans regia (English walnut)
MTGSLVLKLSGMVLLCMVVAAPVAEAVITCGQVASSVGSCIGYLRGTVPTVPPSCCNGVKSLNKAAATTADRQAACECLKKTSGSIPGLNPGLAAGLPGKCGVSVPYKISTSTNCKAVK

SEQ ID NO: 1673 - protein, 507 aa, Juglans regia (English walnut)
MAKPILLSIYLFLIVALFNGCLAQSGGRQQQQFGQCQLNRLDALEPTNRIEAEAGVIESWDPNNQQFQCAGVAVVRRTIEPNGLLLPQYSNAPQLVYIARGRGITGVLFPGCPETFEESQRQSQQGQSREFQQDRHQKIRHFREGDIIAFPAGVAHWSYNDGSNPVVAISLLDTNNNANQLDQNPRNFYLAGNPDDEFRPQGQQEYEQHRRQQQRQQRPGEHGQQQRGLGNNVFSGFDADFLADAFNVDTETARRLQSENDHRRSIVRVEGRQLQVIRPRWSREEQEREERKERERERESESERRQSRRGGRDDNGLEETICTLRLRENIGDPSRADIYTEEAGRISTVNSHTLPVLRWLQLSAERGALYSDALYVPHWNLNAHSVVYALRGRAEVQVVDNFGQTVFDDELREGQLLTIPQNFAVVKRARNEGFEWVSFKTNENAMVSPLAGRTSAIRALPEEVLATAFQIPREDARRLKFNRQESTLVRSRPSRSRSSRSERRAEV

SEQ ID NO: 1674 - protein, 160 aa, Juglans regia (English walnut)
MGVFTYETESTSVIPPARLFKAFVLDADNLIPKVVPQAVKSSEIIEGNGGPGTIKKINFGEGSQYKYVKHRTDAIDEANFTYAYSVIEGDALADKIEKISYETKIVASHEGGSILKSISHYHSKGDHEIKEEDVKDGKEKASGLFKAVEGYLLAHPDAYN

SEQ ID NO: 1675 - protein, 167 aa, Kochia scoparia (Burning bush)
MAKCQAVFLLVGALCVLSLDDVAKAPVSQFHIQGLVYCDTCPYPSSYVLPMLEGATVKLECRNITAGTQTFKAEAVTDKVGQYSIPVDGDFEDDICEIELLKSPDNQCSEVSHDVYAKQSAKVSLTSNNGEASDVRSANALGFMRKEPLEECPEVLKELDLYDVKAN

SEQ ID NO: 1676 - protein, 133 aa, Kochia scoparia (Burning bush)
MSWQTYVDDHLMCDIEGTTNHLTGAAILGVDGSVWAQSANFPQFKPDEIAAIVKEFDEPGTLAPTGLHLGGTKYMVIQGEAGQVIRGKKGPGGICVKKTGQALIFGIYDEPVTPGQCNMIVERLGDYLVEQGM

SEQ ID NO: 1677 - protein, 418 aa, Lens culinaris (Lentil)
SRSDQENPFIFKSNRFQTIYENENGHIRLLQRFDKRSKIFENLQNYRLLEYKSKPHTIFLPQFTDADFILVVLSGKAILTVLNSNDRNSFNLERGDTIKLPAGTIAYLANRDDNEDLRVLDLAIPVNRPGQLQSFLLSGTQNQPSFLSGFSKNILEAAFNTEYEEIEKVLLEEQEQKSQHRRSLRDKRQEITNEDVIVKVSREQIEELSKNAKSSSKKSVSSESEPFNLRSRNPIYSNKFGKFFEITPEKNPQLQDLDIFVNSVEIKEGSLLLPNYNSRAIVIVTVNEGKGDFELVGQRNENQQEQREENDEEEGQEEETTKQVQRYRARLSPGDVLVIPAGHPVAINASSDLNLIGFGINAKNNQRNFLAGEEDNVISQIQRPVKELAFPGSSREVDRLLTNQKQSHFANAQPLQIE

SEQ ID NO: 1678 - protein, 415 aa, Lens culinaris (Lentil)
SRSDQENPFIFKSNRFQTIYENENGHIRLLQKFDKRSKIFENLQNYRLLEYKSKPHTLFLPQYTDADFILVVLSGKAVLTVLNSNDRNSFNLERGDTIKLPAGTIAYLANRDDNEDLRVLDLAIPVNNPGQLESFLLSGTQNQPSFLSGFNKSILEAAFNTDYEEIEKVLLEDQEQEPQHRRSLRDRRQEINKENVIVKVSREQIKELSKNAKSSSKKSVSSESEPFNLRSRNPIYSNKFGKFFEITPEKNPQLQDLDIFVNSVEIKEGSLLLPNYNSRAIVIVTVNEGKGYFELVGQRNENQREENDDEEEQEEETSTQVQRYRAKLSPGDVFVVPAGHPVAINASSDLNLIGFGINAKNNQRNFLAGEEDNVISQIQRPVKELAFPGSSREVDRLLTNQKQSHFANAQPLQIE

SEQ ID NO: 1679 - protein, 118 aa, Lens culinaris (Lentil)
MARGMKLACVVLVICMVVIAPMAEGAISCGAVTSDLSPCLTYLTGGPGPSPQCCGGVKKLLAAANTTPDRQAACNCLKSAAGSITKLNTNNAAALPGKCGVNIPYKISTTTNCNTVKF

SEQ ID NO: 1680 - protein, 145 aa, Ligustrum vulgare (Common privet)
EDVPQPPVSQFYIQGQVYCDTCRARFITELSEFIPGAGVRLQCKDGENGKVTFTEVGYTKAEGLYNMLIERDHKNEFCEITLISSSRKDCDEIPTEGWVKPSLKFVLNTVNGTTRTINPLGFLKKEVLPKCPQVFNKLGMYPPNM

SEQ ID NO: 1681 - protein, 131 aa, Litchi chinensis (Lychee)
MSWQTYVDDHLMCETDGQHLTAAAIIGHDGSVWAQSANFPQFKPAEIAAIMKDFDEPGSLAPTGLHLGGTKYMVIQGEPGAVIRGKKGPGGITVKKTTQALIIGIYDEPMTPGQCNMVVERLGDYLVDQGL

SEQ ID NO: 1682 - protein, 611 aa, Lupinus angustifolius (Narrow?leaved blue lupin)
MAKMRVRLPMLILLLGVVFLLAASIGIAYGEKDFTKNPPKEREEEEHEPRQQPRPRQQEEQEREHRREEKHDGEPSRGRSQSEESQEEEHERRREHHREREQEQQPRPQRRQEEEEEEEEWQPRRQRPQSRREEREEREQEQGSSSGSQRGGGDERRQHRERRVHREEREQEQDSRSDSRRQRNPYHFSSNRFQTYYRNRNGQIRVLERFNQRTNRLENLQNYRIIEFQSKPNTLILPKHSDADFILVVLNGRATITIVNPDKRQVYNLEQGDALRLPAGTTSYILNPDDNQNLRVAKLAIPINNPGKLYDFYPSTTKDQQSYFSGFSKNTLEATFNTRYEEIERVLLGDDELQENEKQRRGQEQSHQDEGVIVRVSKKQIQELRKHAQSSSGEGKPSESGPFNLRSNKPIYSNKFGNFYEITPDINPQFQDLNISLTFTEINEGALLLPHYNSKAIFIVVVDEGEGNYELVGIRDQQRQQDEQEEEYEQGEEEVRRYSDKLSKGDVFIIPAGHPLSINASSNLRLLGFGINANENQRNFLAGSEDNVIKQLDREVKELTFPGSIEDVERLIKNQQQSYFANAQPQQQQQREKEGRRGRRGPISSILNALY

SEQ ID NO: 1683 - protein, 159 aa, Malus domestica (Apple)
MGVYTFENEFTSEIPPSRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKVGKEKAHGLFKLIESYLKDHPDAYN

SEQ ID NO: 1684 - protein, 159 aa, Malus domestica (Apple)
MGVYTFENEFTSEIPPSRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKAGKEKAHGLFKLIESYLKGHPDAYN

SEQ ID NO: 1685 - protein, 159 aa, Malus domestica (Apple)
MGVYTFENEYTSEIPPPRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKAGKEKAHGLFKLIESYLKDHPDAYN

SEQ ID NO: 1686 - protein, 159 aa, Malus domestica (Apple)
MGVCTFENEFTSEIPPSRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKAGKEKAHGLFKLIESYLKDHPDAYN

SEQ ID NO: 1687 - protein, 159 aa, Malus domestica (Apple)
MGVYTFENEFTSEIPPSRLFKAFVLDADNLIPKIAPQAIKQAEILEGNGGPGTIKKITFGEGSQYGYVKHRIDSIDEASYSYSYTLIEGDALTDTIENISYETKLVACGSGSTIKSISHYHTKGNIEIKEEHVKAGKEKAHGLFKLIESYLKDHPDAYN

SEQ ID NO: 1688 - protein, 159 aa, Malus domestica (Apple)
MGVYTFENEYTSEIPPSRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKAGKAKAHGLFKLIESYLKGHPDAYN

SEQ ID NO: 1689 - protein, 159 aa, Malus domestica (Apple)
MGVYTFENEFTSEIPPSRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKAGKEKAHGLFKLIESYLKDHPDAYN

SEQ ID NO: 1690 - protein, 159 aa, Malus domestica (Apple)
MGVCTFENEFTSEIPPSRLFKAFVLDADNLIPKIAPQAIKQAEILEGNGGPGTIKKITFGEGSQYGYVKHRIDSIDEASYSYSYTLIEGDALTDTIEKISYETKLVACGSGSTIKSISHYHTKGNIEIKEEHVKVGKEKAHGLFKLIESYLKDHPDAYN

SEQ ID NO: 1691 - protein, 159 aa, Malus domestica (Apple)
MGVYTFENEYTSEIPPPRLFKAFVLDADNLIPKIAPQAIKHAEILEGDGGPGTIKKITFGEGSQYGYVKHKIDSVDEANYSYAYTLIEGDALTDTIEKVSYETKLVASGSGSIIKSISHYHTKGDVEIKEEHVKAGKEKAHGLFKLIESYLKGHPDAYN

SEQ ID NO: 1692 - protein, 159 aa, Malus domestica (Apple)
MGVYTFENEYTSEIPPPRLFKAFVLDADNLIPKIAPQAIKHAEILEGDGGPGTIKKITFGEGSQYGYVKHKIDSVDEANYSYAYTLIEGDALTDTIEKVSYETKLVASGSGSIIKSISHYHTKGDVEIKEEHVKAGKEKAHGLFKLIESHLKGHPDAYN

SEQ ID NO: 1693 - protein, 159 aa, Malus domestica (Apple)
MGVYTFENEYTSEIPPPRLFKAFVLDADNLIPKIAPQAIKHAEILEGDGGPGTIKKITFGEGSQYGYVKHKIDSVDEANYSYAYTLIEGDALTDTIEKVSYETKLMASGSGSIIKSISHYHTKGDVEIKEEHVKAGKEKAHGLFKLIESYLKGHPDAYN

SEQ ID NO: 1694 - protein, 159 aa, Malus domestica (Apple)
MGVYTFENEYTSEIPPPRLFKAFVLDADNLIPKIAPQAIKHAEILEGDGGPGTIKKITFGEGSQYGYVKHKIDSVDEANYSYAYTLIEGDALTDTIEKVSYETKLVASGSGSIIKSISHYHTKGDVEIKEEHVMAGKEKAHGLFKLIESYLKGHPDAYN

SEQ ID NO: 1695 - protein, 159 aa, Malus domestica (Apple); identical to SEQ ID NO: 1691

SEQ ID NO: 1696 - protein, 159 aa, Malus domestica (Apple)
MGVYTFENEYTSEIPPPRLFKAFVLDADNLIPKIAPQAIKHAEILEGDGGPGTTKKITFGEGSQYGYVKHKIDSVDEANYSYAYTLIEGDALTDTIEKVSYETKLVASGSGSIIKSISHYHTKGDVEIKEEHVKAGKEKAHGLFKLIESYLKGHPDAYN

SEQ ID NO: 1697 - protein, 158 aa, Malus domestica (Apple)
GVYTYENEYTSEIPPPRLFKAFVLDADNLIPKIAPQAIKHAEILEGDGGPGTIKKITFGEGSQYGYVKHKIDSVDEANYSYAYTLIEGDALTDTIEKVSYETKLVASGSGSIIKSISHYHTKGDVEIMEEHVKAGKEKAHGLFKLIESYLKDHPDAYN

SEQ ID NO: 1698 - protein, 159 aa, Malus domestica (Apple)
MGVFNYETEFTSVIPPARLFNAFVLDADNLIPKIAPQAVKSAEILEGDGGVGTIKKINFGEGSTYSYVKHRIDGVDKENFVYKYSVIEGDAISETIEKISYETKLVASGSGSVIKSTSHYHTKSDVEIKEEHVKAGKEKASHLFKLIENYLLAHSDAYN

SEQ ID NO: 1699 - protein, 159 aa, Malus domestica (Apple)
MGVFTYESEFTSVIPPARLFNAFVLDADNLIPKIAPQAVKSAEILEGDGGVGTIKKINFGEGSTYSYVKHRIDGVDKDNFVYKYSVIEGDAISETIEKISYETKLVAAGSGSVIKSTSHYHTKGDVEIKEEHVKAGKEKASHLFKLIENYLLEHQDAYN

SEQ ID NO: 1700 - protein, 159 aa, Malus domestica (Apple)
MGVFTYEFEFTSVIPPARLYNAFVLDADNLIPKIAPQAVKSTEILEGDGGVGTIKKINFGEGSTYSYVKHKIDGVDKDNFVYQYSVIEGDAISETIEKISYETKLVASGSGSVIKSISHYHTKGDVEIKEEHVKAGKEKASHLFKLIENYLLEHHDAYN

SEQ ID NO: 1701 - protein, 159 aa, Malus domestica (Apple)
MGVFTYESEFTSVIPPARLFNAFVLDADNLIPKIAPQAVKSAEILEGDGGVGTIKKINFGEGSTYSYVKHRIDGVDKENFVYKYSVIEGDAISETIEKISYETKLVASGSGSVIKSTSHYHTKGDVEIKEEHVKAGKEKASHLFKLIENYLLEHPDAYN

SEQ ID NO: 1702 - protein, 160 aa, Malus domestica (Apple)
MGVFNYETETTSVIPAPRLFKAFILDGDNLIPKIAPQAIKSTEIIEGDGGVGTIKKVTFGEGSQYGYVKQRVNGIDKDNFTYSYSMIEGDTLSDKLEKITYETKLIASPDGGSIIKTTSHYHAKGDVEIKEEHVKAGKEKASGLFKLLEAYLLAHSDAYN

SEQ ID NO: 1703 - protein, 160 aa, Malus domestica (Apple)
MGVFNYETEFTSVIPAPRLFKAFILDGDNLIPKIAPQAIKSTKIIEGDGGVGTIKKVTFGEGSQYGYVKQRVNGIDKDNFTYSYSMIEGDTLSDKLEKITYETKLIASPDGGSIIKTNSHYHAKGDVEIKEEHVKAGKEKASGLFKLLEAYLLAHSDAYN

SEQ ID NO: 1704 - protein, 160 aa, Malus domestica (Apple)
MGVFNYETEFTSVIPAPRLFKAFILDGDNLIPKIAPQAIKSTEIIEGDGGVGTIKKVTFGEGSQYGYVKQRVNGIDKDNFTYSYSMIEGDTLSDKLEKITYETKLIASPDGGSIIKTTSHYRAKGDVEIKEEHVKAGKEKASGLFKLLEAYLLAHSDAYN

SEQ ID NO: 1705 - protein, 246 aa, Malus domestica (Apple)
MMKSQVASLLGLTLAILFFSGAHAAKITFTNNCPNTVWPGTLTGDQKPQLSLTGFELASKASRSVDAPSPWSGRFWGRTRCSTDAAGKFTCETADCGSGQVACNGAGAVPPATLVEITIAANGGQDYYDVSLVDGFNLPMSVAPQGGTGECKPSSCPANVNKVCPAPLQVKAADGSVISCKSACLAFGDSKYCCTPPNNTPETCPPTEYSEIFEKQCPQAYSYAYDDKNSTFTCSGGPDYVITFCP

SEQ ID NO: 1706 - protein, 115 aa, Malus domestica (Apple)
MASSAVTKLALVVALCMAVSVAHAITCGQVTSSLAPCIGYVRSGGAVPPACCNGIRTINGLARTTADRQTACNCLKNLAGSISGVNPNNAAGLPGKCGVNVPYKISTSTNCATVK

SEQ ID NO: 1707 - protein, 115 aa, Malus domestica (Apple)
MASSAVTKLALVVALCMAVSVAHAITCGQVTSSLAPCIGYVRNGGAVPPACCNGIRTINSLARTTADRQTACNCLKNLAGSISGVNPNNAAGLPGKCGVNVPYKISTSTNCATVK

SEQ ID NO: 1708 - protein, 115 aa, Malus domestica (Apple)
MASSAVIKLALVVALCMAVSVAHAITCGQVSSNLVPCFDYVRSGGPVPPACCNGIRTINGLAKTTPDRQAACNCLKSLAGSVSGVNPGNAESLPGKCGVNVPYKISTSTNCATVK

SEQ ID NO: 1709 - protein, 115 aa, Malus domestica (Apple)
MASSAVINLALVVALCMAVSVAHAITCGQVSSNLVPCFDYVRSDGPVPPACCNGIRTINGLAKTTPDRQAACNCLKSLAGSVSGVNPGNAESLPGKCGVNVPYKISTSTNCATVK

SEQ ID NO: 1710 - protein, 115 aa, Malus domestica (Apple)
MASSAVINLALVVALCMAVSVAHAITCGQVSSNLVPCFDYVRSGGPVPPACCNGIRTINGLAKTTPDRQAACNCLKSLAGSVSGVNPGNVESLPGKCGVNVPYKISTSTNCATVK

SEQ ID NO: 1711 - protein, 131 aa, Malus domestica (Apple)
MSWQAYVDDHLMCDIDGNRLTAAAILGQDGSVWSQSASFPAFKPEEIAAILKDFDQPGTLAPTGLFLGGTKYMVIQGEPGAVIRGKKGSGGITIKKTSQALLIGIYDEPVTPGQCNIVVERLGDYLIEQGL

SEQ ID NO: 1712 - protein, 131 aa, Malus domestica (Apple)
MSWQAYVDDHLMCDIDGYRLTAAAILGQDGSVWSQSASFPAFKPEEIAAILKDFDQPGTLAPTGLFLGGTKYMVIQGEPGAVIRGKKGSGGITIKKTSQALLIGIYDEPVTPGQCNIVVERLGDYLIEQGL

SEQ ID NO: 1713 - protein, 131 aa, Malus domestica (Apple)
MSWQAYVDDHLMCEIEGNHLSAAAIIGHNGSVWAQSATFPQLKPEEVTGIMNDFNEPGSLAPTGLYLGGTKYMVIQGEPGVVIRGKKGPGGVTVKKSTMALLIGIYDEPMTPGQCNMVVERLGDYLIEQGL

SEQ ID NO: 1714 - protein, 131 aa, Malus domestica (Apple)
MSWQAYVDDHLMCEIEGNHLSAAAIIGHDGSVWAQSATFPQLKPEEVTGIMNDFNEPGSLAPTGLYLGGTKYMVIQGEPGVVIRGKKGPGGVTVKKSTMASLIGIYDEPMTPGQCNMVVERLGDYLIEQGL

SEQ ID NO: 1715 - protein, 131 aa, Malus domestica (Apple)
MSWQAYVDDRLMCDIDGHHLTAAAILGHDGSVWAHSSTFPKFKPEEITAIMKDFDEPGSLAPTGLHLGGTKYMVIQGEGGAVIRGKKGSGGVTVKKTGQALVFGIYEEPLTPGQCNMIVERLGDYLIDQGL

SEQ ID NO: 1716 - protein, 131 aa, Malus domestica (Apple)
MSWQAYVDDHLMCDIDGHHLTAAAILGHDGSVWAHSSTFPKFKPEEITAIMKDFDEPGSLAPTGLHLGGTKYMVIQGEGGAVIRGKKGSGGVTVKKTGQALVFGIYEEPLTPGQCNMIVERLGDYLIDQGL

SEQ ID NO: 1717 - protein, 177 aa, Manihot esculenta (Cassava, manioc)
MATAEVVTAQTALPEEKPAEEVKVSEIVTEEAAPAVEPVAEEPKEAEPVAVSEEPKGGDDAPAEVAVETKEVVEVEEAKTVTEEPTVEKTEEEEETPKEETPEPVVVKETPKEEPTAETVVEEAPKETTEAATEAEAPAPESAPASAPETPAEEEVPKEEEGDEKKSEAEVEAEKTE

SEQ ID NO: 1718 - protein, 133 aa, Mercurialis annua (Annual mercury)
MSWQTYVDDHLMCDIDGQGQHLAAASIVGHDGSIWAQSASFPQLKPEEITGIMKDFDEPGHLAPTGLYIAGTKYMVIQGESGAVIRGKKGSGGITIKKTGQALVFGIYEEPVTPGQCNMVVERLGDYLIEQGM

SEQ ID NO: 1719 - protein, 91 aa, Morus nigra (Mulberry)
ITCGQVSSSLAPCINYLRAGGVVPANCCNGVRSLNNAAKTTADRQAACNCLKSAFNSIKGLNLNLAAGLPGKCGVSVPYKISPSTDCKSVK

SEQ ID NO: 1720 - protein, 145 aa, Olea europaea (Olive)
EDIPQPPVSQFHIQGQVYCDTCRAGFITELSEFIPGASLRLQCKDKENGDVTFTEVGYTRAEGLYSMLVERDHKNEFCEITLISSGRKDCNEIPTEGWAKPSLKFKLNTVNGTTRTVNPLGFFKKEALPKCAQVYNKLGMYPPNM

SEQ ID NO: 1721 - protein, 134 aa, Olea europaea (Olive)
MSWQAYVDDHLMCDIEGHEDHRLTAAAIVGHDGSVWAQSATFPQFKPEEMNGIMTDFNEPGHLAPTGLHLGGTKYMVIQGEAGAVIRGKKGSGGITIKKTGQALVFGIYEEPVTPGQCNMVVERLGDYLVEQGM

SEQ ID NO: 1722 - protein, 84 aa, Olea europaea (Olive)
MADDPQEVAEHERIFKRFDANGDGKISSSELGETLKTLGSVTPEEIQRMMAEIDTDGDGFISFEEFTVFARANRGLVKDVAKIF

SEQ ID NO: 1723 - protein, 24 aa, Olea europaea (Olive)
AFANTGVEIVSIDTYLFSLYDEDK

SEQ ID NO: 1724 - protein, 30 aa, Olea europaea (Olive)
MVKAVTVLNSSEGPHGIVYFAQEGDGPTTV

SEQ ID NO: 1725 - protein, 50 aa, Olea europaea (Olive)
DEAQFKECYDTCHKECSDKGNGFTFCEMKCDTDCSVKDVKEKLENYKPKN

SEQ ID NO: 1726 - protein, 21 aa, Olea europaea (Olive)
APSQSTVTALLTSCVSYIDDQ

SEQ ID NO: 1727 - protein, 171 aa, Olea europaea (Olive)
MAANTDRNSKPSVYLQEPNEVQGVFNRFDANGDGKISGDELAGVLKALGSNTSKEEIGRIMEEIDTDKDGFINVQEFAAFVKAETDPYPSSGGENELKEAFELYDQDHNGLISSVELHKILTRLGERYAEHDCVEMIKSVDSDGDGYVSFEEFKKMMTNKSGNNSQAEPPK

SEQ ID NO: 1728 - protein, 460 aa, Olea europaea (Olive)
MAANVQTSSLLFLVFLLLQNFYSANSQSFLGVNYGQLSDNLPSLQATVNLLKSTTIQKVRLFGAEPAVIKAFANTGVEIVIGFDNGDIPTLASNPNVASQFVKSNVMSFYPASNIIAITVGNEVLTSGDQKLISQLLPAMQNVQNALNAASLGGKVKVSTVHAMAVLSQSYPPSSGVFNPGLGDTMKALLQFQSANDAPFMISPYPYFAYKNQPTPDTLAFCLFQPNAGQVDSGNGHKYTNMFDAQVDAVHSALNAMGFKDIEIVVAETGWPHGGDSNEVGPSLDNAKAYVGNLINHLKSKVGTPLMPGKSIDTYLFSLYDEDKKTGASSEKYFGLFKPDGSTTYDVGLLKNTQNPTTPATPTPTPKAAGSWCVPKPGVSDDQLTGNINYACGQGIDCGPIQPGGACFEPNTVKAHAAYVMNLYYQSAGRNSWNCDFSQTATLTNTNPSYGACNFPSGSN

SEQ ID NO: 1729 - protein, 123 aa, Olea europaea (Olive)
MRGTAGVPDQPVPTPTPSVPTSSSPVPKPPTQGNKKWCVPKAEATDAQLQSNIDYVCSQSGMDCGPIQANGACFNPNTVRAHASYAMNSWYQSKGRNDFDCDFSGTGAITSSDPSNGSCSFLS

SEQ ID NO: 1730 - protein, 364 aa, Olea europaea (Olive)
MSCIAVEAVLLGILLYIPIVLSDDRAPIPSNSAQLNSWFDGIIQPVAVRKATMDPALVTAEGQTKVIKLKSDGSGDFKSINEAIKSIPDDNTKRVILSLAPGNYSEKVKIGMYKHYITFYGEDPNNMPILVFGGTAAEYGTVDSATLIVESNYFSAVNLKIVNSAPRPDGKRVGAQAAALRISGDKASFYNVKIYGFQDTLCDDKGKHFYKDCYIEGTVDFIFGSGKSIFLNTELHAVPGDQPAIITAQARKTDSEDTGYYFVNCRVTGGGAFLGRSWMPAAKVVFAYTEMVDAIHPEGWILVKPEHESTVRFSEYNNKGPGANMEKRAKFVKRLSDAEAKQSISLGSIEASKWLLPPRVVGLP

SEQ ID NO: 1731 - protein, 160 aa, Ostrya carpinifolia (European hophornbeam)
MGVFNYEAETPSVIPAARLFKSYVLDGDKLIPKVAPQAISKVENVGGNGGPGTIKNITFAEGSPFKFVKERVDEVDNANFKYNYTVIEGDVLGDKLEKVSHELKIVAAPGGGSILKISSKFHAKGDHEVNAEEMKGAKEMAEKLLRAVESYLLAHTAEYN

SEQ ID NO: 1732 - protein, 139 aa, Parietaria judaica (Pellitory?of?the?Wall)
QETCGTMVRALMPCLPFVQGKEKEPSKGCCSGAKRLDGETKTGPQRVHACECIQTAMKTYSDIDGKLVSEVPKHCGIVDSKLPPIDVNMDCKTVGVVPRQPQLPVSLRHGPVTGPSDPAHKARLERPQIRVPPPAPEKA

SEQ ID NO: 1733 - protein, 176 aa, Parietaria judaica (Pellitory?of?the?Wall)
MRTVSAPSAVALVVIVAAGLAWTSLASVAPPAPAPGSEETCGTVVRALMPCLPFVQGKEKEPSKGCCSGAKRLDGETKTGLQRVHACECIQTAMKTYSDIDGKLVSEVPKHCGIVDSKLPPIDVNMDCKTLGVVPRQPQLPVSLRHGPVTGPSDPAHKARLERPQIRVPPPAPEKA

SEQ ID NO: 1734 - protein, 139 aa, Parietaria judaica (Pellitory?of?the?Wall)
QETCGTMVRALMPCLPFVQGKEKEPSKGCCSGAKRLDGETKTGPQRVHACECIQTAMKTYSDIDGKLVSEVPKHCGIVDSKLPPIDVNMDCKTLGVVPRQPQLPVSLRHGPVTGPSDPAHKARLERPQIRVPPPAPEKA

SEQ ID NO: 1735 - protein, 138 aa, Parietaria judaica (Pellitory?of?the?Wall)
MRTVSARSSVALVVIVAAVLVWTSSASVAPAPAPGSEETCGTVVGALMPCLPFVQGKEKEPSKGCCSGAKRLDGETKTGPQRVHACECIQTAMKTYSDIDGKLVSEVPKHCGIVDSKLPPIDVNMDCKTLGVLHYKGN

SEQ ID NO: 1736 - protein, 133 aa, Parietaria judaica (Pellitory?of?the?Wall)
MRTVSMAALVVIAAALAWTSSAEPAPAPAPGEEACGKVVQDIMPCLHFVKGEEKEPSKECCSGTKKLSEEVKTTEQKREACKCIVRATKGISGIKNELVAEVPKKCDIKTTLPPITADFDCSKIQSTIFRGYY

SEQ ID NO: 1737 - protein, 133 aa, Parietaria judaica (Pellitory?of?the?Wall)
MRTVSMAALVVIAAALAWTSSAELASAPAPGEGPCGKVVHHIMPCLKFVKGEEKEPSKSCCSGTKKLSEEVKTTEQKREACKCIVAATKGISGIKNELVAEVPKKCGITTTLPPITADFDCSKIESTIFRGYY

SEQ ID NO: 1738 - protein, 132 aa, Parietaria judaica (Pellitory?of?the?Wall)
MSWQAYVDDHLMCDVGDGNTPASAAIIGHDGSVWAQSANFPQLKPEEVTGIMNDFNEAGFLAPTGLFLGGTKYMVIQGESGAVIRGKKGSGGATLKKTGQAIVIGIYDEPMTPGQCNLVVERLGDYLLEQGL

SEQ ID NO: 1739 - protein, 131 aa, Parietaria judaica (Pellitory?of?the?Wall)
MSWQAYVDDHLMCDVGDGNTLASAAIIGHDGSVWAQSANFPQLKPEEVTGIMNDFNEGGFLAPTGLFLGGTKYMVIQGESGAVIGKKGSGGATLKKTGQAIVIGIYDEPMTPGQCNLVVERLGDYLLEQGM

SEQ ID NO: 1740 - protein, 131 aa, Parietaria judaica (Pellitory?of?the?Wall)
MSWQTYVDDHLMCEIEGNHLTAAAILGQDGSVWAQSASFPQFKPEEIAAIVKDFEEPGTLAPTGLFLGGAKYMVIQGEAGVVIRGKKGSGGVTVKKTGQALVIGIYDEPMAPGQCNMIVERLGDYLIETGL

SEQ ID NO: 1741 - protein, 84 aa, Parietaria judaica (Pellitory?of?the?Wall)
MADKQIDRAEQERIFKRFDSNGDGKISSSELGEALKALGSVTADEVHRMMAEIDTDGDGAISLEEFSSFADANRGLIKDIAKIF

SEQ ID NO: 1742 - protein, 156 aa, Parthenium hysterophorus (Feverfew)
MAKSSTSYLVFLLLVLVVAISEIASVNGKVCEKPSKTWFGNCKDTEKCDKRCMEWEGAKHGACHQRESKYMCFCYFDCDPKKNPGPPPGAPGTPGTPPAPPGGGEGDAPPGGGAPPPAGGEGGGGGGEGGGGAPPPAGGEGGGGGGDGGGGAPPAA

SEQ ID NO: 1743 - protein, 326 aa, Persea americana (Avocado)
MVYCTASLPLLLLLLVGLLAGEAFAEQCGRQAGGALCPGGLCCSQFGWCGSTSDYCGPTCQSQCGGVTPSPGGGVASLISQSVFNQMLKHRNDAACQAKGFYTYNAFIAAANSFNGFASVGDTATRKREIAAFLAQTSHETTGGWATAPDGPYAWGYCFLKEQGNPPDYCVPTAQWPCAPGKKYYGRGPIQISYNYNYGPAGRAIGYDLINNPDAVATDPVISFKTALWFWMTPQSPKPSCHNVITGRWTPSAADRAAGRLPGYGVITNIINGGIECGKGFNDKVADRIGFYKRYCDLLGVSYGSNLDCYNQRSFGVSTNPLAASS

SEQ ID NO: 1744 - protein, 115 aa, Phaseolus vulgaris (Green bean, French bean)
MASVKFACVVVLCMVVVGAHTAQGMTCGQVQSNLVPCVTFLQNGGFVPAGCCNGVRNIMNSARSTADRRGICNCLKTAAGAVRGLNPNNAQALPGKCGVNIPYKISTSTNCASIN

SEQ ID NO: 1745 - protein, 118 aa, Phaseolus vulgaris (Green bean, French bean)
MATLNSACVVAVLCLVVLTAPTAHAAISCGQVTSSLASCIPFLTKGGPVPASCCSGVRSLNAAAKTTPDRQAVCNCLKSAAGAIPGFNANNAGILPGKCGVSIPYKISTSTNCATIKF

SEQ ID NO: 1746 - protein, 149 aa, Pistacia vera (Pistachio)
MAKLVLLLSAFAFLILAANASIYRATVEVEGENLSSGQSCQKQFEEQQKFKHCQMYVQQEVQKSQDGHSLTARINQRQQCFKQCCQELQEVDKKCRCQNLEQMVKRQQQQGQFRGEKLQELYETASELPRMCNISPSQGCQFSSPYWSY

SEQ ID NO: 1747 - protein, 496 aa, Pistacia vera (Pistachio)
MGYSSLLSFSLGFLLLFHCSFAQIEQVVNSQQRQQQQRFQTQCQIQNLNALEPKRRIESEAGVTEFWDQNEEQLQCANVAVFRHTIQSRGLLVPSYDNAPELVYVVQGSGIHGAVFPGCPETFQEESQSRSRSERSQQSGEQHQKVRPIQEGDVIALPAGVAHWIYNNGQSKLVLVALADVGNSENQLDQYLRKFVLGGSPQQEIQGSGQSRSRSQSQSSRRGQQGQQSNNILSAFDEEILAQSFNIDTQLARRLQKEKRQRGIIVRVQEDLEVLSPHRQEQEQEYEEERERRQRNGLEETFCTMTLKYNINDPSRADVYNPRGGRVSSVNALNLPILRFLQLSAKKGVLHRDAILAPHWNVNAHSIVYITRGNGRIQIVSENGESVFDEEIREGQLVVVPQNFAVVKRASSDKFEWVSFKTNGLSQTSQLAGRVSVFRALPLDVIKNSFDISREDARRLKESRSETTIFAPGSSSQRKSQSERERQREREEREIH

SEQ ID NO: 1748 - protein, 472 aa, Pistacia vera (Pistachio)
MGYSSLLSFSLGFLLLFHCSFAQIEQVVNSQQRQQQQRFQTQCQIQNLNALEPKRRIESEAGVTEFWDQNEEQLQCANVAVFRHTIQSRGLLVPSYNNAPELVYVVQGSGIHGAVFPGCPETFQEESQSQSRSQHSRSERSQQSGEQHQKVRHIREGDIIALPAGVAHWIYNNGQSKLVLVALADVGNSENQLDQYLRKFVLGGSPQQEIQGGGQSWSQSRSSRKGQQSNNILSAFDEEILAQSFNIDTQLVKKLQREEKQRGIIVRVKEDLQVLSPQRQEKEYSDNGLEETFCTMTLKLNINDPSRADVYNPRGGRVTSINALNLPILRFLQLSVEKGVLYQNAIMAPHWNMNAHSIVYITRGNGRMQIVSENGESVFDEEIREGQLVVVPQNFAVVKRASSDGFEWVSFKTNGLAKISQLAGRISVMRGLPLDVIQNSFDISREDAWNLKESRSEMTIFAPGSRSQRQRN

SEQ ID NO: 1749 - protein, 519 aa, Pistacia vera (Pistachio)
KTDPELKQCKHQCKVQRQYDEEQKEQCAKGCEKYYKEKKGREQEEEEEEEWGSGRGRGDEFSTHEPGEKRLSQCMKQCERQDGGQQKQLCRFRCQEKYKKERREHSYSRDEEEEEEGDEEQEEEDENPYVFEDEHFTTRVKTEQGKVVVLPKFTKRSKLLRGLEKYRLAFLVANPQAFVVPNHMDADSIFFVSWGRGTITKIRENKRESMNVKQGDIIRIRAGTPFYIVNTDENEKLYIVKLLQPVNLPGHYEVFHGPGGENPESFYRAFSREVLEAALKTPRDKLEKLFEKQDEGAIVKASKEQIRAMSRRGEGPSIWPFTGKSTGTFNLFKKDPSQSNNYGQLFESEFKDYPPLQELDIMVSYVNITKGGMSGPFYNSRATKIAIVVSGEGRLEIACPHLSSSKNSGQEKSGPSYKKLSSSIRTDSVFVVPAGHPFVTVASGNQNLEILCFEVNAEGNIRYTLAGKKNIIEVMEKEAKELAFKTKGEEVDKVFGKQDEEFFFQGPKWRQHQQGRADE

SEQ ID NO: 1750 - protein, 230 aa, Pistacia vera (Pistachio)
MALLSYVTRKTLTESLRLGLKSHVRGLQTFTLPDLPYEYGALEPAISSEIMQLHHQKHHQTYITNYNKALEQLDQAINKGDASAVVKLQSAIKFNGGGHINHSIFWKNLTPVSEGGGEPPHGSLGWAIDTNFGSMEALIQRMNAEGAALQGSGWVWLGLDKESKKLVVETTANQDPLVTKGPSLVPLLGIDVWEHAYYLQYKNVRPDYLKNIWKVINWKYAGELYQKECP

SEQ ID NO: 1751 - protein, 473 aa, Pistacia vera (Pistachio)
MANPSLLSLSVCLLILFHGCLASRQQGQQQNECQIDQLDALEPDNRVEYEAGMVETWDPNHEQFRCAGVAVARHTIQPNGLRLPEYSNAPTLMYIVEGEGMTGTLIPGCPETYQAPQQGQQHGQSSRFQDKHQKIQRFRKGDIIALPAGVANWCYNEGNSPVVTVTLLDVSNSQNQLDMYPRKFNLAGNPEDEFQQQQQQQSRGRRQSQQKSCNNIFCGFDTKILAEVFQVEQSLVKQLQNEKDNRGAIVKVKGDLQVIRPPRRQSERGFESEEESEYERGRRGRDNGLEETICTMKLKENIHDPSRSDIYTPEVGRITSLNSLNLPILKWLQLSAERGVLQNNALMVPHWNFNAHSIVYGCKGNAQVQVVDNFGNTVFDGEVSEGQIFVVPQNFAVVKRARGQRFEWISFKTNDRAMISPLAGSTSVLRAMPEEVLANAFQISREDARKIKFNNEQPTLSSGQSSQQMRDDA

SEQ ID NO: 1752 - protein, 415 aa, Pisum sativum (Pea)
SRSDQENPFIFKSNRFQTLYENENGHIRLLQKFDKRSKIFENLQNYRLLEYKSKPHTLFLPQYTDADFILVVLSGKATLTVLKSNDRNSFNLERGDAIKLPAGTIAYLANRDDNEDLRVLDLAIPVNKPGQLQSFLLSGTQNQPSLLSGFSKNILEAAFNTNYEEIEKVLLEQQEQEPQHRRSLKDRRQEINEENVIVKVSREQIEELSKNAKSSSKKSVSSESGPFNLRSRNPIYSNKFGKFFEITPEKNQQLQDLDIFVNSVDIKEGSLLLPNYNSRAIVIVTVTEGKGDFELVGQRNENQGKENDKEEEQEEETSKQVQLYRAKLSPGDVFVIPAGHPVAINASSDLNLIGFGINAENNERNFLAGEEDNVISQVERPVKELAFPGSSHEVDRLLKNQKQSYFANAQPLQRE

SEQ ID NO: 1753 - protein, 415 aa, Pisum sativum (Pea)
SRSDQENPFIFKSNRFQTLYENENGHIRLLQKFDKRSKIFENLQNYRLLEYKSKPRTLFLPQCTDADFILVVLSGKATLTVLKSNDRNSFNLERGDTIKLPAGTIAYLANRDDNEDLRVLDLTIPVNKPGQLQSFLLSGTQNQPSLLSGFSKNILEAAFNTNYEEIEKVLLEQQEQEPQHRRSLKDRRQEINEENVIVKVSREQIEELSKNAKSSSKKSVSSESGPFNLRSRNPIYSNKFGKFFEITPEKNQQLQDLDIFVNSVDIKEGSLLLPNYNSRAIVIVTVTEGKGDFELVGQRNENQGKENDKEEEQEEETSKQVQLYRAKLSPGDVFVIPAGHPVAINASSDLNLIGFGINAENNERNFLAGEEDNVISQVERPVKELAFPGSSHEVDRLLKNQKQSYFANAQPLQRE

SEQ ID NO: 1754 - protein, 571 aa, Pisum sativum (Pea)
MATTVKSRFPLLLFLGIIFLASVCVTYANYDEGSETRVPGQRERGRQEGEKEEKRHGEWRPSYEKEEHEEEKQKYRYQREKKEQKEVQPGRERWEREEDEEQVEEEWRGSQRREDPEERARLRHREERTKRDRRHQREGEEEERSSESQEHRNPFLFKSNKFLTLFENENGHIRRLQRFDKRSDLFENLQNYRLVEYRAKPHTIFLPQHIDADLILVVLNGKAILTVLSPNDRNSYNLERGDTIKIPAGTTSYLVNQDDEEDLRVVDFVIPVNRPGKFEAFGLSENKNQYLRGFSKNILEASLNTKYETIEKVLLEEQEKKPQQLRDRKRTQQGEERDAIIKVSREQIEELRKLAKSSSKKSLPSEFEPFNLRSHKPEYSNKFGKLFEITPEKKYPQLQDLDILVSCVEINKGALMLPHYNSRAIVVLLVNEGKGNLELLGLKNEQQEREDRKERNNEVQRYEARLSPGDVVIIPAGHPVAISASSNLNLLGFGINAKNNQRNFLSGSDDNVISQIENPVKELTFPGSSQEVNRLIKNQKQSHFASAEPEQKEEESQRKRSPLSSVLDSFY

SEQ ID NO: 1755 - protein, 120 aa, Pisum sativum (Pea)
MARSMKLACVALVICMVVIAPMAEAALSCGTVSADMAPCVTYLQAPNNASPPPPCCAGVKKLLAAATTTPDRQAACNCLKSAAGSIPKLNTNNAAALPGKCGVSIPYKISTSTNCNTVRF

SEQ ID NO: 1756 - protein, 131 aa, Plantago lanceolata (English plantain)
TQTSHPAKFHVEGEVYCNVCHSRNLINELSERMAGAQVQLDCKDDSKKVIYSIGGETDQDGVYRLPVVGYHEDCEIKLVKSSRPDCSEIPKLAKGTIQTSKVDLSKNTTITEKTRHVKPLSFRAKTDAPGC

SEQ ID NO: 1757 - protein, 42 aa, Plantago lanceolata (English plantain)
AILGQDGSVWAQGLHLGGAKYVIAGEPGAVIRLGDYLLDQGL

SEQ ID NO: 1758 - protein, 179 aa, Platanus acerifolia (London plane tree)
MKLSFSLCIFFFNLLLLLQAVISADIVQGTCKKVAQRSPNVNYDFCVKSLGADPKSHTADLQGLGVISANLAIQHGSKIQTFIGRILKSKVDPALKKYLNDCVGLYADAKSSVQEAIADFKSKDYASANVKMSAALDDSVTCEDGFKEKKGIVSPVTKENKDYVQLTAISLAITKLLGA

SEQ ID NO: 1759 - protein, 377 aa, Platanus acerifolia (London plane tree)
RGVQSSGSVFNVNDYGAKGAGDISQAVMKAWKAACASQGPSTVLIPKGNYNMGEVAMQGPCKGSKIGFQIDGVVKAPADPSKFKSDGWVSFYRIDGLTVSGTGTLDGQGQTAWAKNNCDKNPNCKHAAMNLRFDFLKHAMVRDITSLNSKMFHINVLECEDITFQHVTVTAPGTSINTDGIHVGISKGVTITNTKIATGDDCISIGPGSQNVTITQVNCGPGHGISIGSLGRYNNEKEVRGITVKGCTFSGTMNGVRVKTWPNSPPGAATDLTFQDLTMNNVQNPVILDQEYCPYGQCSRQAPSRIKLSNINFNNIRGTSTGKVAVVIACSHGMPCSNMKIGEINLSYRGAGGPATSTCSNVKPTFSGKQVPAIKCA

SEQ ID NO: 1760 - protein, 170 aa, Platanus orientalis (Oriental plane)
MKLSFSLCIFFLISADIVQGTCKKVAQRSPNVNYDFCVKSLGADPKSHSADLQGLGVISANLAIQQGSKIQTFIGRILKSKVDPALKKYLNDCVGLYADAKSSVQEAIADFKSKDYASANVKMSAALDDSVTCEDGFKEKKGIASPVTKENKDYVQLTAISLAITKLLGA

SEQ ID NO: 1761 - protein, 378 aa, Platanus orientalis (Oriental plane)
MRGVQSSGGTFNVNDYGAKGSGDISQAVMKAWEAACASPGPSTVLIPTGNYIMGEVLLEGPCKGSKIGFQLDGVVKAPADVSAFKSEGWVVFNHVDGLTVSGKGTFDGQGQKAWAANNCDKDENCNRPPMNIRFNFLKNAVVRDITSMNSKMFHINVLECDNISFQHVTISAPGTSINTDGIHIGLSRGVTITDTNIATGDDCVSIGPGSQNVTVTKVNCGPGHGISVGSLGKYKDEKDVRGITVTGCTFTGTSNGVRVKTWPDSPPGVATDMAFEDLTMKNVQNPVILDQEYCPYGQCSLKAPSRVKLSNIKFNNIRGTSSGPDAIVIACSHGFPCSNLEIGEINLALHAAGAPANSTCTNAKPIFSGKQVPAIKCA

SEQ ID NO: 1762 - protein, 118 aa, Platanus orientalis (Oriental plane)
MAFSRVAKLACLLLACMVATAPHAEAAITCGTVVTRLTPCLTYLRSGGAVAPACCNGVKALNNDAKTTPDRQAACGCLKTASTSISGIQLGNAASLAGKCGVNLPYKISPTIDCSKVK

SEQ ID NO: 1763 - protein, 150 aa, Prosopis juliflora (Mesquite)
DDVAKPPVSQFHIQGLVYCDTCRIQFMTRVSTIMEGATVKLECRNITAGTQTFKAEAVTDKVGQYSIPVNGDFEDDICEIELVKSPNSDCSEIPHDVYAKQSAKVSLTSNNGEASDIRSANALGFMRKEPLKECPEVSKEPLDMYDVKAN

SEQ ID NO: 1764 - protein, 133 aa, Prosopis juliflora (Mesquite)
MSWQTYVDDHLMCEIEGTNNHLSAAAILGVDGSVWAQSASFPQFKPDEISAVVKDFDGPGTLAPTGLHLGGTKYMVIQGEPGQVIRGKKGPGGICVKKTGQALIIGIYDEPVTPGQCNMIVERLGDYLVEQGM

SEQ ID NO: 1765 - protein, 160 aa, Prunus armeniaca (Apricot)
MGVFTYETEFTSVIPPEKLFKAFILDADNLIPKVAPTAVKGTEILEGDGGVGTIKKVTFGEGSQYAYVKHRVDGIDKDNLSYSYTLIEGDALSDVIENIAYDIKLVASPDGGSIVKTTSHYHTKGDVEIKEEQVKAGKEKAAGLFKLVEAYLLANPDAYN

SEQ ID NO: 1766 - protein, 91 aa, Prunus armeniaca (Apricot)
ITCGQVSSSLAPCIGYVRGGGAVPPACCNGIRNVNNLARTTPDRRTACNCLKQLSGSISGVNPNNAAALPGKCGVNIPYKISASTNCATVK

SEQ ID NO: 1767 - protein, 160 aa, Prunus avium (Sweet cherry)
MGVFTYESEFTSEIPPPRLFKAFVLDADNLVPKIAPQAIKHSEILEGDGGPGTIKKITFGEGSQYGYVKHKIDSIDKENYSYSYTLIEGDALGDTLEKISYETKLVASPSGGSIIKSTSHYHTKGNVEIKEEHVKAGKEKASNLFKLIETYLKGHPDAYN

SEQ ID NO: 1768 - protein, 160 aa, Prunus avium (Sweet cherry)
MGVFTYSDESTSVIPPPRLFKALVLEADTLIPKIAPQSVKTAEIVEGDGGVGTIKKISFGEGSHYSYVKHRIDGLDKDNFVYNYTLVEGDALSDKIEKITYEIKLVASADGGSIIKSTSNYHTTGDVEIKEEDVKAGKEKATGLFKLIENYLAANPDACN

SEQ ID NO: 1769 - protein, 160 aa, Prunus avium (Sweet cherry)
MGVFTYADESTSVIPPPRLFKALVLEADTLIPKIAPQSVKSAEIVEGDGGVGTIKKISFGEGSHYSYVKHRIDGLDKDNFVYSYSLVEGDALSDKVEKISYEIKLVASADGGSIIKSTSNYHTTGDVEIKEEDVKAGKEKATGLFKLIENYLVANPDAYN

SEQ ID NO: 1770 - protein, 160 aa, Prunus avium (Sweet cherry)
MGVFTYADESTSVITPPRLFKALVLEADTLIPKIAPQSVKGAEIVEGDGGVGTIKKISFGEGSHYSYVKHRIDGLDKDNFVYSYSLVEGDALSDKVEKISYEIKLVASADGGSIIKSTSNYHTTGDVEIKEEDVRAGKEKATGLFKLIENYLVANPDAYN

SEQ ID NO: 1771 - protein, 245 aa, Prunus avium (Sweet cherry)
MMKTLVVVLSLSLTILSFGGAHAATISFKNNCPYMVWPGTLTSDQKPQLSTTGFELASQASFQLDTPVPWNGRFWARTGCSTDASGKFVCATADCASGQVMCNGNGAIPPATLAEFNIPAGGGQDFYDVSLVDGFNLPMSVTPQGGTGDCKTASCPANVNAVCPSELQKKGSDGSVVACLSACVKFGTPQYCCTPPQNTPETCPPTNYSEIFHNACPDAYSYAYDDKRGTFTCNGGPNYAITFCP

SEQ ID NO: 1772 - protein, 117 aa, Prunus avium (Sweet cherry)
MACSAMTKLALVVALCMVVSVPIAQALTCGQVSSNLAPCIAYVRGGGAVPPACCNGIRNINNLAKTTADRQTACNCLKQLSASVPGVNANNAAALPGKCGVNVPYKISPSTNCATVK

SEQ ID NO: 1773 - protein, 131 aa, Prunus avium (Sweet cherry)
MSWQAYVDDHLMCDIDGNRLTAAAILGQDGSVWSQSATFPAFKPEEIAAILKDLDQPGTLAPTGLFLGGTKYMVIQGEAGAVIRGKKGSGGITVKKTNQALIIGIYDEPLTPGQCNMIVERLGDYLIEQGL

SEQ ID NO: 1774 - protein, 91 aa, Prunus domestica (European plum)
ITCGQVSSNLAPCINYVKGGGAVPPACCNGIRNVNNLARTTADRRAACNCLKQLSGSIPGVNPNNAAALPGKCGVNVPYKISASTNCATVK

SEQ ID NO: 1775 - protein, 123 aa, Prunus dulcis (Almond)
MASSGQLLKLVCLVAVMCCMAVGGPKAMAAVSCGQVVNNLTPCINYVANGGALNPSCCTGVRSLYSLAQTTADRQSICNCLKQAVNGIPYTNANAGLAAGLPGKCGVNIPYKISPSTDCKTIK

SEQ ID NO: 1776 - protein, 131 aa, Prunus dulcis (Almond)
MSWQQYVDDHLMCDIDGNRLTAAAILGQDGSVWSQSATFPAFKPEEIAAILKDFDQPGTLAPTGLFLGGTKYMVIQGEAGAVIRGKKGSGGITVKKTNQALIIGIYDEPLTPGQCNMIVERLGDYLIEQGL

SEQ ID NO: 1777 - protein, 113 aa, Prunus dulcis (Almond)
MKVVAAYLLAVLGGNTTPSAEDLKDILGSVGAETDDDRIQLLLSEVKGKDITELIASGREKLASVPSGGGAVAVAAPGAGAGAAAPAAAEPKKEEKVEEKEDTDDDMGFSLFD

SEQ ID NO: 1778 - protein, 551 aa, Prunus dulcis (Almond)
MAKAFVFSLCLLLVFNGCLAARQSQLSPQNQCQLNQLQAREPDNRIQAEAGQIETWNFNQEDFQCAGVAASRITIQRNGLHLPSYSNAPQLIYIVQGRGVLGAVFSGCPETFEESQQSSQQGRQQEQEQERQQQQQGEQGRQQGQQEQQQERQGRQQGRQQQEEGRQQEQQQGQQGRPQQQQQFRQFDRHQKTRRIREGDVVAIPAGVAYWSYNDGDQELVAVNLFHVSSDHNQLDQNPRKFYLAGNPENEFNQQGQSQPRQQGEQGRPGQHQQPFGRPRQQEQQGSGNNVFSGFNTQLLAQALNVNEETARNLQGQNDNRNQIIRVRGNLDFVQPPRGRQEREHEERQQEQLQQERQQQGGQLMANGLEETFCSLRLKENIGNPERADIFSPRAGRISTLNSHNLPILRFLRLSAERGFFYRNGIYSPHWNVNAHSVVYVIRGNARVQVVNENGDAILDQEVQQGQLFIVPQNHGVIQQAGNQGFEYFAFKTEENAFINTLAGRTSFLRALPDEVLANAYQISREQARQLKYNRQETIALSSSQQRRAVV

SEQ ID NO: 1779 - protein, 504 aa, Prunus dulcis (Almond)
CLLLLFNGCLASRQHIFGQNKEWQLNQLEAREPDNHIQSEAGVTESWNPSDPQFQLAGVAVVRRTIEPNGLHLPSYVNAPQLIYIVRGRGVLGAVFPGCAETFEDSQPQQFQQQQQQQQFRPSRQEGGQGQQQFQGEDQQDRHQKIRHIREGDIIALPAGVAYWSYNNGEQPLVAVSLLDLNNDQNQLDQVPRRFYLAGNPQDEFNPQQQGRQQQQQQQGQQGNGNNIFSGFDTQLLAQALNVNPETARNLQGQDDNRNEIVRVQGQLDFVSPFSRSAGGRGDQERQQEEQQSQREREEKQREQEQQGGGGQDNGVEETFCSARLSQNIGDPSRADFYNPQGGRISVVNRNHLPILRYLRLSAEKGVLYNNAIYTPHWHTNANALVYAIRGNARVQVVNENGDPILDDEVREGQLFLIPQNHAVITQASNEGFEYISFRTDENGFTNTLAGRTSVLRALPDEVLQNAFRISRQEARNLKYNRQESRLLSATSPPRGRLMSILGY

SEQ ID NO: 1780 - protein, 88 aa, Prunus mume (Japanese apricot)
MKLGFATFLLVCLLLSSSVFEVTMAGSSFCDSKCGVRCSKAGYQERCLKYCGICCEKCHCVPSGTYGNKDECPCYRDLKNSKGNPKCP

SEQ ID NO: 1781 - protein, 160 aa, Prunus persica (Peach)
MGVFTYESEFTSEIPPPRLFKAFVLDADNLVPKIAPQAIKHSEILEGDGGPGTIKKITFGEGSQYGYVKHKIDSIDKENHSYSYTLIEGDALGDNLEKISYETKLVASPSGGSIIKSTSHYHTKGDVEIKEEHVKAGKEKASNLFKLIETYLKGHPDAYN

SEQ ID NO: 1782 - protein, 246 aa, Prunus persica (Peach)
MMKSQAALLGLTTLAILFFSGAHAAKITFTNKCSYTVWPGTLTGDQKPQLSLTGFKLATGISRSVDAPSPWSGRFFGRTRCSTDASGKFTCATADCGSGQVSCNGNGAAPPATLVEITIASNGGQDFYDVSLVDGFNLPMSVAPQGGTGKCKASTCPADINKVCPAPLQVKGSDGSVIACKSACLAFNQPKYCCTPPNDKPETCPPTDYSKLFKTQCPQAYSYAYDDKSSTFTCSGRPDYLITFCP

SEQ ID NO: 1783 - protein, 246 aa, Prunus persica (Peach)
MMKSQAALLGLTTLAILFFSGAHAAKITFTNKCSYTVWPGTLTGDQKPQLSLTGFELATGISNSVDAPSPWSGRFFGRTRCSTDASGKFTCATADCGSGQVSCNGNGAVPPATLVEITIAENGGQDFYDVSLVDGFNLPMSVAPQGGTGECKASTCPADINKVCPAELQVKGSDGSVIACKSACLALNQPQYCCTPPNDKPETCPPTDYSKLFKTQCPQAYSYAYDDKSSTFTCSGRPDYLITFCP

SEQ ID NO: 1784 - protein, 242 aa, Prunus persica (Peach)
MMKTLVAVLSLSLTLLSFGGAHAATMSFKNNCPYTVWPASFGNPQLSTTGFELASQASFQLDTPVPWSGRFWARTRCSTDASGKFVCETADCDSGQLMCNGKTGIPPATLAEFTIAAGGGQDFYDVSLVDGFNLPMSVTPQGGTGTCKMGSCAANVNLVCPSELQKIGSDGSVVACLSACVKFGEPQYCCTPPQETKEKCPPTNYSQIFHEQCPDAYSYAFDDNKGLFTCSGGPNYLITFCP

SEQ ID NO: 1785 - protein, 91 aa, Prunus persica (Peach)
ITCGQVSSALAPCIPYVRGGGAVPPACCNGIRNVNNLARTTPDRQAACNCLKQLSASVPGVNPNNAAALPGKCGVHIPYKISASTNCATVK

SEQ ID NO: 1786 - protein, 91 aa, Prunus persica (Peach)
ITCGQVSSSLAPCIPYVRGGGAVPPACCNGIRNVNNLARTTPDRQAACNCLKQLSASVPGVNPNNAAALPGKCGVSIPYKISASTNCATVK

SEQ ID NO: 1787 - protein, 131 aa, Prunus persica (Peach)
MSWQAYVDDHLMCDIDGNRLTAAAILGQDGSVWSQSATFPAFKPEEIAAILKDFDQPGTLAPTGLFLGGTKYMVIQGEAGAVIRGKKGSGGITVKKTNQALIIGIYDEPLTPGQCNMIVERLGDYLIEQGL

SEQ ID NO: 1788 - protein, 63 aa, Prunus persica (Peach)
GSSFCDSKCGVRCSKAGYQERCLKYCGICCEKCHCVPSGTYGNKDECPCYRDLKNSKGNPKCP

SEQ ID NO: 1789 - protein, 120 aa, Punica granatum (Pomegranate)
MTGSGLFKLACAVFAVALVAAPIATEAAVTCGQVASSLAPCIPYARSAGGAVPPACCSGIKTLDGMARTTPDRQATCKCLKSASTSISGINYGLVASLPAKCGVNIPYKISPSTDCARVK

SEQ ID NO: 1790 - protein, 120 aa, Punica granatum (Pomegranate)
MASKRFLNNLVPALFLCMVVAASVVESAVTCGQVTSSLTPCIPYARGVVAAPSAACCSGVRSLNNAAKTTPDRQTACNCLKVIARSITGINYGRVGALPGKCGVSIPYKISPSTDCSRVK

SEQ ID NO: 1791 - protein, 111 aa, Punica granatum (Pomegranate)
MASSGFLRLAGFVLVCMAVASTVAEAGITCGQVSSSLAGCIQYARGNGAGPVPQACCNGIRSLNSAAKTTPDRQAACRCLKSLASSISGINYGLVAGAPGKCGVSIPYKIA

SEQ ID NO: 1792 - protein, 159 aa, Pyrus communis (Pear)
MGLYTFENEFTSEIPPPRLFKAFVLDADNLIPKIAPQAIKHAEILEGNGGPGTIKKITFGEGSQYGYVKHRVDSIDEASYSYAYTLIEGDALTDTIEKISYEAKLVASGSGSTIKSISHYHTKGDIEIKEEHVKAGKEKAHGLFKLIESYLKDHPDAYN

SEQ ID NO: 1793 - protein, 115 aa, Pyrus communis (Pear)
MASSAVIKLALVVALCMAVSVAHAITCSQVSANLAPCINYVRSGGAVPPACCNGIKTINGLAKTTPDRQAACNCLKNLAGSVSGVNPGNAESLPGKCGVNVPYKISTSTNCATVK

SEQ ID NO: 1794 - protein, 131 aa, Pyrus communis (Pear)
MSWQAYVDDHLMCDIDGHHLTAAAILGHDGSVWAQSSTFPKFKPEEITAIMKDFDEPGSLAPTGLHLGGTKYMVIQGEGGAVIRGKKGSGGVTVKKTSQALVFGIYEEPLTPGQCNMIVERLGDYLIDQGL

SEQ ID NO: 1795 - protein, 308 aa, Pyrus communis (Pear)
MASKSQILFIGGTGYIGKFIVEASAKAGYPTYVLVREASLSDPAKSKVIENFKALGVNFVLGDLYDHESLVKAIKQVDVVISTVGHGQLADQGKIIAAIKEAGNVKRFFPSEFGNDVDRSHAVEPAKSAFETKAKIRRAVEAEGIPYTYVSSNFFAGYFLPTLNQPGASSAPRDKVVILGDGNPKAIFNKEDDIGTYTIRAVDDPRTLNKVLYIRPPANTISFNELVSLWEKKIGKTLERIYVPEEQLLKNIQEAAVPLNVILSISHAVFVKGDHTNFEIEPSFGVEATALYPDVKYTTVDEYLNQFV

SEQ ID NO: 1796 - protein, 159 aa, Quercus alba (White oak)
MGVFTHESQETSVIAPARLFKALFLDSDNLIQKVLPQAIKSTEIIEGNGGPGTIKKITFGEASKFKYAKHRIDALDPENCTYSFSVIEGDALTVMESVSTEIKCVASPDGGSIMKSTTKYQTKGDFQLKEEQIQAAIEKAAGLLKAVEAYLVAHPDLYK

SEQ ID NO: 1797 - protein, 160 aa, Quercus alba (White oak)
MGVFTYESEDASVIPPARLFKAFVLDSDNLIPKVVPQALKSTEIIEGNGGPGTIKKITFGEGSHLKHAKHRIDVIDPENFTYSFSVIEGDALFDKLENVSTETKIVASPDGGSIVKSTSKYQTKGDFQLTDELIRGGKEKASEVFKAVEAYLVAHPDLYK

SEQ ID NO: 1798 - protein, 160 aa, Quercus alba (White oak)
MGVFTHESQETSVIAPARLFKALFLDSDNLIQKVLPQAIKSTEIIEGNGGPGTIKKITFGEGSHLKHAKHRIDVIDPENFTYSFSVIEGDALFDKLENVSTETKIVASPDGGSIAKSTSKYQTKGDFQLTDELIRGGKEKASGVFKAVEAYLVAHPDLYK

SEQ ID NO: 1799 - protein, 258 aa, Ricinus communis (Castor bean)
MAKLIPTIALVSVLLFIIANASFAYRTTITTIEIDESKGEREGSSSQQCRQEVQRKDLSSCERYLRQSSSRRSPGEEVLRMPGDENQQQESQQLQQCCNQVKQVRDECQCEAIKYIAEDQIQQGQLHGEESERVAQRAGEIVSSCGVRCMRQTRTNPSQQGCRGQIQEQQNLRQCQEYIKQQVSGQGPRRSDNQERSLRGCCDHLKQMQSQCRCEGLRQAIEQQQSQGQLQGQDVFEAFRTAANLPSMCGVSPTECRF

SEQ ID NO: 1800 - protein, 137 aa, Rubus idaeus (Red raspberry)
YTSVIPPPKLFKAFVLDADNLIPKIAPQAVKSVEIIEGDGGVGTVKKIHLGEGTEHSYVKHKIDGLDKVNFVYSYSITEGDALGDKIEKISYEIKLVASGRGSIIKTTSHYHCKGGAEIKEEQVKDGKERAAGLFKI

SEQ ID NO: 1801 - protein, 117 aa, Rubus idaeus (Red raspberry)
MACSAVMKLALVALLCIVVAVPVAQAITCGQVTQNVAPCFNYVKNGGAVPAACCNGVRNLNSQAKTTADRQQTCNCLKNAAGSIPGLNPSLAAGLPGKCGVSVPYKISTSTNCATVK

SEQ ID NO: 1802 - protein, 42 aa, Salsola kali (Russian thistle, Saltwort)
PTITIGGPEYRTIFFDAYLGTSYVIVIKEPAEEFTTISDAVK

SEQ ID NO: 1803 - protein, 362 aa, Salsola kali (Russian thistle, Saltwort)
MEEHVSMLLVGFVLINIAFTSIAQLIPPNPAELESWFQGAVKPVSEQKGLEPSVVQTESGGVETIEVRQDGSGKFKTISDAVKHVKVGNTKRVIITIGPGEYREKVKIERLHPYITLYGIDPKNRPTITFAGTAAEFGTVDSATVIVESDYSVGAHLIVTNSAPRPDGKRKGAQAGALRISGDRAAFYNCKFTGFQDTVCDDKGNHFFTDCYTEGTVDFIFGEARSLYLNTELHVVPGDPMAMITAHARKNADGVGGYSFVHCKVTGTGGTALLGRAWFDAARVVFSYCNLSDAAKPEGWSDNNKPEAQKTILFGEYKNTGPGAAPDKRAPYTKQLTEADAKTFTSLEYIEAAKWLLPPPKV

SEQ ID NO: 1804 - protein, 339 aa, Salsola kali (Russian thistle, Saltwort)
QPIPPNPAELESWFQGAVKPVSEQKGLEPSVVQAESGGVETIEVRQDGSGKFKTISDAVKHVKVGNTKRVIITIGPGEYREKVKIERLHPYITLYGIDPKNRPTITFAGTAAEFGTVDSATLIVESDYFVGANLIVSNSAPRPDGKRKGARASALRISGDRAAFYNCKFTGFQDTVCDDKGNHLFKDCYIEGTVDFIFGEARSLYLNTELHVVPGDPMAMITAHARKNADGVGGYSFVHCKVTGTGGTALLGRAWFEAARVVFSYCNLSDAVKPEGWSDNNKPAAQKTIFFGEYKNTGPGAAADKRVPYTKQLTEADAKTFTSLEYIEAAKWLLPPPKV

SEQ ID NO: 1805 - protein, 339 aa, Salsola kali (Russian thistle, Saltwort)
QPIPPNPAELESWFQGAVKPVSEQKGLEPSVVQAESGGVETIEVRQDGSGKFKTISDAVKHVKVGNTKRVIITIGPGEYREKVKIEGLHPYITLYGIDPKNRPTITFAGTAAEFGTVDSATLIVESDYFVGANLIVSNSAPRPAGKRKGAQASALRISGDRAAFYNCKFTGFQDTVCDDKGNHLFKDCYIEGTVDLIFGEARSLYLNTELHVVPGDPMAMITAHARKNADGVGGYSFVHCKVTGTGGTALLGRAWFEAARVVFSYCNLSDAVKPEGWSDNNKPAAQKTIFFGEYKNTGPGAAADKRVPYTKQLTEADAKTFTSLEYIEAAKWLPPPPKV

SEQ ID NO: 1806 - protein, 320 aa, Salsola kali (Russian thistle, Saltwort)
MVVADLERLKCQAAMDASQLRERLVDLEEHKRRIAEQKAARHEDEERRLGTTQSPISYRVYTLKEIEVGTDYFSSSLKIGEGGYGPVYRAMLQHTPVAIKVLRPNVSQGLKQFQQEIDVLGRMRHPNMVLLVGACPEYGCLVYEYMENGSLEDRLFRKNNSPPIPWKLRFKIAAEIAIALLFLRDAKPEPMVHRDLKPANILLDGNYISKIADVGLARLVPPTVANEITQYHMTAAAGTFCYIDPEYQQTGQLGTKSDIYSFGIILLQLLTARPPMALSYHVEEAIDAGNFEEVLDPSISDWPVQEALSLAQLALKCCEG

SEQ ID NO: 1807 - protein, 757 aa, Salsola kali (Russian thistle, Saltwort)
MASHVVGYPRMGPKRELKFALESFWDGKSSAEDLKKVAADLRSSIWKQMADAGIKYIPSNTFAYYDQVLDTTAMLGAVPARYGFNGGEIGFDLYFSMARGNASLPAMEMTKWFDTNYHYIVPELGPEVKFAYSSHKAVDEYKEAKALGVDTVPVLVGPVSYLLLSKAAKGVEKSFPLLSLLPKILPVYKEVIAELKAAGASTIQFDEPTLVMDLESHQLKAFTDAYADLESTLSGLNVLVETYFADLTPEAYKTLVSLNGVTAFGFDLVRGTKTLDLIKSGFPSGKYLFAGVVDGRNIWANDLAASLATLQSLESIVGKDKLVVSTSCSLLHTAVDLVNETKLDDEIKSWLAFAAQKVLEVNALAKALAGQKDEAFFSANAAALASRKSSPRVTNEAVQKAAAGLKGSDHRRATTVSARLDAQQKKLNLPVLPTTTIGSFPQTVELRRVRREYKAKKISEEEYVKAIKEEISKVVKLQEELDIDVLVHGEPERNDMVEYFGEQLSGFAFTVNGWVQSYGSRCVKPPIIYGDVSRPKAMTVFWSSLAQSMTSRPMKGMLTGPVTILNWSFVRNDQPRHETCYQIALAIEDEAEDLEKAGINVIQIDEAALREGLPLRKSGHGFYLQWAVHSFRITNVGIQDTTQIHTHMCYSNFNDIIHSIIDMDADVITIENSRSDEKLLSVFREGVKYGAGIGPGVYDIHSPRIPPTEELADRIRKMLAVLESNVLWVNPDCGLKTRKYNEVNPALSNMVYAAKPI

SEQ ID NO: 1808 - protein, 133 aa, Salsola kali (Russian thistle, Saltwort)
MSWQTYVDDHLMCEIEGTNNHLTAAAILGVDGSVWAQSANFPQFKPDEISAVVKEFDEAGTLAPTGLHLGGTKYMVIQGEAGQVIRGKKGPGGICVKKTGQALIFGIYDEPVTPGQCNMIVERLGDYLVEQGM

SEQ ID NO: 1809 - protein, 133 aa, Salsola kali (Russian thistle, Saltwort)
MSWQAYVDEHLMCNIEDTGNHLTSSAIVGVDGSIWAQSSNFPQVKPQEIEAINKEFDGPNTLAPTGLFLGGEKYMVIQGEPGAVIRGKKGPGGVCIKKTTQALIFGIYDEPVAPGQCNMVVERLGDYLIEQGL

SEQ ID NO: 1810 - protein, 151 aa, Salsola kali (Russian thistle, Saltwort)
KGKGGHNLYHVKGMVYCDTCRIQFITRVSTMMEGATVSLQCRNLTAGTETFKAEAVTDKLGMYTIKVDGDHEDDICQIVLVKSPGQECSEIPNDVYSEQAAKVTLTSNNGEASDVRNANALGFLKKAPLPECPEVLKELDMYDVPGSVTQN

SEQ ID NO: 1811 - protein, 153 aa, Sesamum indicum (Sesame)
MAKKLALAAVLLVAMVALASATTYTTTVTTTAIDDEANQQSQQCRQQLQGRQFRSCQRYLSQGRSPYGGEEDEVLEMSTGNQQSEQSLRDCCQQLRNVDERCRCEAIRQAVRQQQQEGGYQEGQSQQVYQRARDLPRRCNMRPQQCQFRVIFV

SEQ ID NO: 1812 - protein, 148 aa, Sesamum indicum (Sesame)
MARFTIVLAVLFAAALVSASAHKTVVTTSVAEEGEEENQRGCEWESRQCQMRHCMQWMRSMRGQYEESFLRSAEANQGQFEHFRECCNELRDVKSHCRCEALRCMMRQMQQEYGMEQEMQQMQQMMQYLPRMCGMSYPTECRMRPIFA

SEQ ID NO: 1813 - protein, 585 aa, Sesamum indicum (Sesame)
MSCGGRLCLVLFALLLASAVVASESKDPELKQCKHQCKAQQQISKEQKEACIQACKEYIRQKHQGEHGRGGGDILEEEVWNRKSPIERLRECSRGCEQQHGEQREECLRRCQEEYQREKGRQDDDNPTDPEKQYQQCRLQCRRQGEGGGFSREHCERRREEKYREQQGREGGRGEMYEGREREEEQEEQGRGRIPYVFEDQHFITGFRTQHGRMRVLQKFTDRSELLRGIENYRVAILEAEPQTFIVPNHWDAESVVFVAKGRGTISLVRQDRRESLNIKQGDILKINAGTTAYLINRDNNERLVLAKLLQPVSTPGEFELFFGAGGENPESFFKSFSDEILEAAFNTRRDRLQRIFGQQRQGVIVKASEEQVRAMSRHEEGGIWPFGGESKGTINIYQQRPTHSNQYGQLHEVDASQYRQLRDLDLTVSLANITQGAMTAPHYNSKATKIALVVDGEGYFEMACPHMSRSRGSYQGETRGRPSYQRVASRLTRGTVVIIPAGHPFVAVASSNQNLQVLCFEVNANNNEKFPLAGRRNVMNQLEREAKELAFGMPAREVEEVSRSQQEEFFFKGPRQQQQGRADA

SEQ ID NO: 1814 - protein, 166 aa, Sesamum indicum (Sesame)
MADRDRPHPHQIQVHPQHPHRYEGGVKSLLPQKGPSTTQILAIITLLPISGTLLCLAGITLVGTLIGLAVATPVFVIFSPVLVPAAILIAGAVTAFLTSGAFGLTGLSSLSWVLNSFRRATGQGPLEYAKRGVQEGTLYVGEKTKQAGEAIKSTAKEGGREGTART

SEQ ID NO: 1815 - protein, 145 aa, Sesamum indicum (Sesame)
MAEHYGQQQQTRAPHLQLQPRAQRVVKAATAVTAGGSLLVLSGLTLAGTVIALTIATPLLVIFSPVLVPAVITIFLLGAGFLASGGFGVAALSVLSWIYRYLTGKHPPGADQLESAKTKLASKAREMKDRAEQFSQQPVAGSQTS

SEQ ID NO: 1816 - protein, 459 aa, Sesamum indicum (Sesame)
MVAFKFLLALSLSLLVSAAIAQTREPRLTQGQQCRFQRISGAQPSLRIQSEGGTTELWDERQEQFQCAGIVAMRSTIRPNGLSLPNYHPSPRLVYIERGQGLISIMVPGCAETYQVHRSQRTMERTEASEQQDRGSVRDLHQKVHRLRQGDIVAIPSGAAHWCYNDGSEDLVAVSINDVNHLSNQLDQKFRAFYLAGGVPRSGEQEQQARQTFHNIFRAFDAELLSEAFNVPQETIRRMQSEEEERGLIVMARERMTFVRPDEEEGEQEHRGRQLDNGLEETFCTMKFRTNVESRREADIFSRQAGRVHVVDRNKLPILKYMDLSAEKGNLYSNALVSPDWSMTGHTIVYVTRGDAQVQVVDHNGQALMNDRVNQGEMFVVPQYYTSTARAGNNGFEWVAFKTTGSPMRSPLAGYTSVIRAMPLQVITNSYQISPNQAQALKMNRGSQSFLLSPGGRRS

SEQ ID NO: 1817 - protein, 497 aa, Sesamum indicum (Sesame)
MALTSLLSFFIVVTLLIRGLSAQLAGEQDFYWQDLQSQQQHKLQARTDCRVERLTAQEPTIRFESEAGLTEFWDRNNQQFECAGVAAVRNVIQPRGLLLPHYNNAPQLLYVVRGRGIQGTVIPGCAETFERDTQPRQDRRRRFMDRHQKVRQFRQGDILALPAGLTLWFYNNGGEPLITVALLDTGNAANQLDQTFRHFFLAGNPQGGRQSYFGRPQTEKQQGETKNIFNGFDDEILADAFGVDVQTARRLKGQDDLRGRIVRAERLDIVLPGEEEEERWERDPYSGANGLEETLCTAKLRENLDEPARADVYNPHGGRISSLNSLTLPVLSWLRLSAEKGVLYRNGLVAPHWNLNAHSIIYITRGSGRFQVVGHTGRSVFDGVVREGQLIIVPQNYVVAKRASQDEGLEWISFKTNDNAMTSQLAGRLSAIRAMPEEVVMTAYQVSRDEARRLKYNREESRVFSSTSRYSWPRSSRPMSYMPKPFEYVLDVIKSMM

SEQ ID NO: 1818 - protein, 145 aa, Sinapis alba (Yellow mustard)
PAGPFRIPKCRKEFQQAQHLRACQQWLHKQAMQSGSGPSWTLDDEFDFEDDMENPQGPQQRPPLLQQCCNELHQEEPLCVCPTLKGASKAVKQQVRQQLGQQGQQGPHLQHVISRIYQTATHLPKVCNIRQVSVCPFKKTMPGPS

SEQ ID NO: 1819 - protein, 510 aa, Sinapis alba (Yellow mustard)
MVKLAHLLVATVGVLLVLNGCLARQSLGVPPQVKDACNLDNLDVLQPTEVIKSEAGQVEYWDHNHPQIRCAGVSIARLVIQKGGLYLPTFFSSPFISYVVQGMGISGRVIPGCAETFMDSQPMQGQQGQQQGQQGQQGQQGQQGQQGQQGQQGQQGQQGQQGQQGQQGQQGQGFRDMHQKVEHVRHGDAIAMTPGSAQWIYNTGDQPLIIVSLIDIANYQNQLDRNPRTFRLAGNNQQGSSQQQQQQQQNILSGFDPQVLAQALKIDVRLAQELQNQQDKRGNIVRVKGPFQVVRPPLRQAYESEQWRHPRGPPQSPQDNGLEETICSMRTHENIDDPARADIYKPNLGRVTSVNSYTLPILQYIRLSATRGILQGSAMVLPKYNMNANEILYCTQGQARIQVVNDNGQNVLDQQVQKGQLVVIPQGFAYVVQSQNNFEWISFKTNANAMISTLAGRTSALRALPLEVITNAYQISLEEARKIKFNTLETTLTRARGGQQPQLIEEIVEV

SEQ ID NO: 1820 - protein, 92 aa, Sinapis alba (Yellow mustard)
ALSCGTVNSNLAACIGYLTQNAPLPKGCCTGVTNLNNMARTTPDRQQACRCLVGAANSFPSLNAARAAALPKACGVNIPYKISKSTNCNSVR

SEQ ID NO: 1821 - protein, 131 aa, Sinapis alba (Yellow mustard)
MSWQTYVDDHLMCDVEGNRLTAAAILGQDGSVWAQSANFPQLKPEEIKGINNDFAEPGTLAPTGLFIGGTKYMVIQGEPNAVIRGKKGAGGVTIKKTTQAFVFGIYEEPMTPGQCNMVVERLGDYLIEQGL

SEQ ID NO: 1822 - protein, 131 aa, Solanum lycopersicum (Lycopersicon esculentum) (Tomato)
MSWQTYVDEHLLCENEGNHLTSAAIIGQDGTVWAQSANFPQFKPEEITGIMNDFAVPGTLAPTGLYLGGTKYMVIQGEPEAVIRGKKGPGGITIKKTNQALIIGIYDEPMTPGQCNMIVERLGDYLIEQSL

SEQ ID NO: 1823 - protein, 553 aa, Solanum lycopersicum (Lycopersicon esculentum) (Tomato)
MATQCYDPENSASRYTLLPDQPDSGHRKSLKIISGIFLSVFLLLSVAFFPILNNQSPDLQIDSRSPAPPSRGVSQGVSDKTFRDVAGASHVSYAWSNAMLSWQRTAYHFQPQKNWMNDPNGPLYHKGWYHLFYQYNPDSAIWGNITWGHAVSKDLIHWLYLPFAMVPDQWYDINGVWTGSATILPDGQIMMLYTGDTDDYVQVQNLAYPANLSDPLLLDWVKFKGNPVLVPPPGIGVKDFRDPTTAWTGPQNGQWLLTIGSKIGKTGVALVYETSNFTSFKLLDGVLHAVPGTGMWECVDFYPVSTKKTNGLDTSYNGPGVKHVLKASLDDNKQDHYAIGTYDLGKNKWTPDNPELDCGIGLRLDYGKYYASKTFYDPKKERRVLWGWIGETDSESADLQKGWASVQSIPRTVLYDKKTGTHLLQWPVEEIESLRVGDPTVKQVDLQPGSIELLRVDSAAELDIEASFEVDKVALQGIIEADHVGFSCSTSGGAASRGILGPFGVIVIADQTLSELTPVYFYISKGADGRAETHFCADQTRFAFLSGTINLSL

SEQ ID NO: 1824 - protein, 636 aa, Solanum lycopersicum (Lycopersicon esculentum) (Tomato)
MATQCYDPENSASRYTLLPDQPDSGHRKSLKIISGIFLSVFLLLSVAFFPILNNQSPDLQIDSRSPAPPSRGVSQGVSDKTFRDVAGASHVSYAWSNAMLSWQRTAYHFQPQKNWMNDPNGPLYHKGWYHLFYQYNPDSAIWGNITWGHAVSKDLIHWLYLPFAMVPDQWYDINGVWTGSATILPDGQIIMLYTGDTDDYVQVQNLAYPANLSDPLLLDWVKFKANPVLVPPPGIGVKDFRDPITAWTGPQNGQWLLTIGSKIGKTGVALVCETSNFTSFKLLDGVLHAVPGTGMWECVDFYPVSTKKTNGLDTSYNGPGVKHVLKASLDDNKQDHYAIGTYDLGKNKWTPDNPELDCGIGLRLDYGKYYASKTFYDPKRERRVLWGWIGETDSESADLQKGWASVQSIPRTVLYDKKTGTHLLQWPVEEIESLRVGDPTVKQVDLQPGSIELLRVDSAAELDIEASFEVDKVALQGIIEADHVGFSCSTSGGAASRGILGPFGVIVIADQTLSELTPVYFYISKGADGRAETHFCADQTRSSEAPGVGKQVYGSSVPVLDGEKHSMRLLVDHSIVESFAQGGRTVITSRIYPTKAVNGAARLFVFNNATGASVTASVKIWSLESANIQSFPLQDL

SEQ ID NO: 1825 - protein, 114 aa, Solanum lycopersicum (Lycopersicon esculentum) (Tomato)
MEMFGKIACFVVFCMVVVAPHAESLSCGEVTSGLAPCLPYLEGRGPLGGCCGGVKGLLGAAKTPEDRKTACTCLKSAANSIKGIDTGKAAGLPGVCGVNIPYKISPSTDCSTVQ

SEQ ID NO: 1826 - protein, 160 aa, Solanum lycopersicum (Lycopersicon esculentum) (Tomato)
MGVNTYTYESTTTISPTRLFKALVLDFDNLVPKLLSQHVKNNETIEGDGGVGSIKQMNFVEGGPIKYLKHKIHVIDDKNLETKYSLIEGDILGEKLESITYDIKFEANDNGGCVYKTTTEYHTKGDHVVSEEEHNVGRERIMNISKAVEAYLLANPSVYA

SEQ ID NO: 1827 - protein, 160 aa, Solanum lycopersicum (Lycopersicon esculentum) (Tomato)
MGVNTFTHESTTTIAPTRLFKGLVLDFDSLVPKLLSHDVKSIEIVEGDGGAGSIKQMNFVEGGPIKYLKHKIHVIDDKNLVTKYSLIEGDVLGDKLESIAYDVKFEAAGDGGCVCKTTTEYHTKGDHVVSEEEHNVGKGKAIDLFKAIEAYLLANPSVYA

SEQ ID NO: 1828 - protein, 171 aa, Solanum lycopersicum (Lycopersicon esculentum) (Tomato)
MANPKVFFDLTIGGAPAGRVVMELFADTTPKTAENFRALCTGEKGVGKMGKPLHYKGSTFHRVIPGFMCQGGDFTAGNGTGGESIYGAKFNDENFVKKHTGPGILSMANAGPGTNGSQFFICTAKTEWLNGKHVVFGQVVEGMDVIKKAEAVGSSSGRCSKPVVIADCGQL

SEQ ID NO: 1829 - protein, 94 aa, Solanum lycopersicum (Lycopersicon esculentum) (Tomato)
MTKVCSFVAVMLVMILVCDQFGANEAATCSASQLSPCLGAIQGGTAPSQDCCARLKNQQPCICGFMKDPNLRQYVNSPNARKVAGQCGVSIPSC

SEQ ID NO: 1830 - protein, 386 aa, Solanum tuberosum (Potato)
MATTKSFLILFFMILATTSSTCAKLEEMVTVLSIDGGGIKGIIPAIILEFLEGQLQEVDNNKDARLADYFDVIGGTSTGGLLTAMITTPNENNRPFAAAKDIVPFYFEHGPHIFNYSGSIFGPRYDGKYLLQVLQEKLGETRVHQALTEVAISSFDIKTNKPVIFTKSNLAKSPELDAKMYDICYSIAAAPIYFPPHHFVTHTSNGATYEFNLVDGGVATVGDPALLSLSVATRLAQEDPAFSSIKSLDYKQMLLLSLGTGTNSEFDKTYTAEEAAKWGPLRWMLAIQQLTNAASSYMTDYYISTVFQARHSQNNYLRVQENALTGTTTEMDDASEANMELLVQVGETLLKKPVSKDSPETYEEALKRFAKLLSNRKKLRANKASY

SEQ ID NO: 1831 - protein, 188 aa, Solanum tuberosum (Potato)
ESPLPKPVLDTNGKELNPNSSYRIISIGRGALGGDVYLGKSPNSDAPCPDGVFRYNSDVGPSGTPVRFIPLSGGIFEDQLLNIQFNIATVKLCVSYTIWKVGNLNAYFRTMLLETGGTIGQADSSYFKIVKLSNFGYNLLYCPITPPFLCPFCRDDNFCAKVGVVIQNGKRRLALVNENPLDVLFQEV

SEQ ID NO: 1832 - protein, 186 aa, Solanum tuberosum (Potato)
TCHDDDNLVLPEVYDQDGNPLRIGERYIIKNPLLGAGAVYLDNIGNLQCPNAVLQHMSIPQFLGKGTPVVFIRKSESDYGDVVRLMTAVYIKFFVKTTKLCVDETVWKVNNEQLVVTGGNVGNENDIFKIKKTDLVIRGMKNVYKLLHCPSHLECKNIGSNFKNGYPRLVTVNDEKDFIPFVFIKA

SEQ ID NO: 1833 - protein, 222 aa, Solanum tuberosum (Potato)
MKSINILSFLLLSSTLSLVAFARSFTSENPIVLPTTCHDDDNLVLPEVYDQDGNPLRIGERYIINNPLLGAGAVYLYNIGNLQCPNAVLQHMSIPQFLGEGTPVVFVRKSESDYGDVVRVMTVVYIKFFVKTTKLCVDQTVWKVNDEQLVVTGGKVGNENDIFKIMKTDLVTPGGSKYVYKLLHCPSHLGCKNIGGNFKNGYPRLVTVDDDKDFIPFVFIKA

SEQ ID NO: 1834 - protein, 221 aa, Solanum tuberosum (Potato)
MKCLFLLCLCLVPIVVFSSTFTSKNPINLPSDATPVLDVAGKELDSRLSYRIISTFWGALGGDVYLGKSPNSDAPCANGIFRYNSDVGPSGTPVRFIGSSSHFGQGIFENELLNIQFAISTSKLCVSYTIWKVGDYDASLGTMLLETGGTIGQADSSWFKIVKSSQFGYNLLYCPVTSTMSCPFSSDDQFCLKVGVVHQNGKRRLALVKDNPLDVSFKQVQ

SEQ ID NO: 1835 - protein, 145 aa, Syringa vulgaris (Lilac)
EDVPQPPVPQFHIQGQVYCDTCRARFITELSEFIPGAGIRLQCKDGEHGKITFTEIGYTRAEGLYSMLVEGDHKNEFCEITLLSSSRKDCEEIPIEGWVKPSLKFILNTVNGTTRTINPLGFFKKEVLPKCPQVFNKLGMYPPNM

SEQ ID NO: 1836 - protein, 145 aa, Syringa vulgaris (Lilac)
EDVPQPPVPQFHIQGQVYCDTCRARFITELSEFIPGASIRLQCKDGENGKITFTEIGYTRAEGLYSMLVEGDHKNEFCEITLISSGRKDCDEIPVEGWVKPSLKFKLNTVNGTTRTINPIGFFKKEALPKCTQVYNKLGMYPPNM

SEQ ID NO: 1837 - protein, 81 aa, Syringa vulgaris (Lilac)
MAEEVAELERIFKRFDANGDGKISSSELGETLKTLGSVTPEEIQRMMAEIDTDGDGFISFEEFKDFARANSGLIKDVAKIF

SEQ ID NO: 1838 - protein, 11 aa, Triplochiton scleroxylon (Obeche)
EQGGSQAGGSL

SEQ ID NO: 1839 - protein, 155 aa, Vigna radiata (Mung bean)
MAVFTFDDQATSPVAPATLYNALAKDADNIIPKAVGSFQSVEIVEGNGGPGTIKKISFVEDGETKFVLHKIESVDEANLGYSYSIVGGVALPDTAEKITIDTKISDGADGGSLIKLTISYHGKGDAPPNEDELKAGKAKSDALFKAVEAYLLANP

SEQ ID NO: 1840 - protein, 453 aa, Vigna radiata (Mung bean)
MVRARVQLLLGILFLASLSVSFGIVHREHQESQEESDSRGQNNPFYFNSDRRFHTLFKNQYGHLRVIHRFDQRSKQIQNLENYRVVEFKSKPNTLLLPHHADADFLLVVLNGRAILTLVNPDGRDSYILEQGHAQKIPAGTTFFLVNPNDNDNLRIIKLAIPVNNPHRFQNFFLSSTEAQQSYLRGFSKNILEASFDSDFKEIDRVLFGEERQQQHGEESQEEGVIVELKREQIRELIKHAKSSSRKELSSQDEPFNLRNSNPIYSNKFGRWYEITPEKNPQLKDLDVFISSVDMKEGGLLLPHYNSKAIVILVINEGEAKIELVGPSDQQQQDESLEVQRYRAELSEDDVFVIPAAYPVAINATSNLNFFAFGINAENNQRNFLAGEKDNVMSEIPTEVLDVSFPASGNKVEKLIKKQSESHFVDAQPEQQQREEGHKGRKGSLSSILGSLY

SEQ ID NO: 1841 - protein, 454 aa, Vigna radiata (Mung bean)
MVRARIPLLLLLGILFLASLSVSFGIVHRENIDGAEVSVSRGKNNPFYFNSDRWFHTLFRNQFGHLRVLQRFDQRSKQMQNLENYRVVELMSKPNTLLLPHHADADFLLVVLNGRAVLTLVNPDGRDSNILEQGHAQKIPAGTTFFLVNPDDNENLRIIKLAVPVNNPHRFQDFFLSSTEAQQSYLQGFSKNILEASFDSDIKEISRVLFGEEGQQQQQGQESQQEGVIVELKREQIRELTKHAKSSSKKSLSSEDQPFNLRNQKPIYSNKLGRWFEITPEKNPQLRDLDMFIRSVDMKEGSLLLPHYNSKAIVILVINEGKANIELVGQREQQKQQEEQEESWEVQRYRAELSEDDVFIIPATYPVAINATSNLNFFAFGINAENNQRNFLAGEKDNVISEIPTEVLDVTFPASGEKVKKLIKKQSESQFVDAQPEQQEREEARKGGKGPFVY

SEQ ID NO: 1842 - protein, 272 aa, Vigna radiata (Mung bean)
MSNLPYINAAFRFSSRDYEVYFFAKNKYVRLQYTPGKTEDKILTNLRLISSGFPSLAGTPFAEPGIDSAFHTEASEAYVFSANNRAYIDYAPGTTNDKILAGPTTIAEMFPVLRNTVFADSIDSAFRSTKGKEVYLFKGNKYVRIDYDSKQLVGSIRNISDGFPVLNGTGFESGIDASFASHKEPEAYLFKGDKYVRIHFTPGKTDDTLVGDVRPILDGWPVLKAFCLCELNKPSLSCINHLSLVTINKAFISNVCLFFFNVTLGLEACFLS

SEQ ID NO: 1843 - protein, 155 aa, Vigna radiata (Mung bean)
MVKEFNTQTELSVRLEALWAVLSKDFITVVPKVLPHIVKDVQLIEGDGGVGTILIFNFLPEVSPSYQREEITEFDESSHEIGLQVIEGGYLNQGLSYYKTTFKLSEIEEDKTLVNVKISYDHDSDIEEKVTPTKTSQSTLMYLRRLERYLSNGSA

SEQ ID NO: 1844 - protein, 119 aa, Vitis vinifera (Grape)
MGSSGAVKLACVMVICMVVAAPAVVEATVTCGQVASALSPCISYLQKGGAVPAGCCSGIKSLNSAAKTTGDRQAACKCLKTFSSSVSGINYGLASGLPGKCGVSVPYKISPSTDCSKVT

SEQ ID NO: 1845 - protein, 330 aa, Ziziphus mauritiana (Chinese?date)
MVPQAKLVVASLILTSALIQTSEAVGGIATYWGQYTETEEGSLAEACASNLYSYINIAYLNIFGEGRYLSLNISGHCSDCTFLGEEIKACQSQGVKIFLSLGGPYGDYHLTTDGDADRVAEQLWSSFLGGSKSTGVYQPLLGDVELDGIDLDIQIGPPEEYDVLARNLKDLTKDRTRPFYLSAAPKCSAYNDSDAYLWTAVETGLFDFVWVKFYNDTSCQYNNDTAAGLDAFYRSWYDWTVSLAEGNKLLIGIPASNETDNSPLGGYIPSDVLNDQIVSVIMTSSKFGGVNVWNRYYDLKTNYSSSIILEYVNSGTKYLPLRTKFMYQNA

SEQ ID NO: 1846 - protein, 375 aa, Chamaecyparis obtusa (Japanese cypress)
MASCTLLAVLVFLCAIVSCFSDNPIDSCWRGDANWDQNRMKLADCAVGFGSSAMGGKGGAFYTVTSSDDDPVNPAPGTLRYGATRERSLWIIFSKNLNIKLNMPLYIAGNKTIDGRGAEVHIGNGGPCLFMRTVSHVILHGLNIHGCNTSVSGNVLISEASGVVPVHAQDGDAITMRNVTDVWIDHNSLSDSSDGLVDVTLASTGVTISNNHFFNHHKVMLLGHSDIYSDDKSMKVTVAFNQFGPNAGQRMPRARYGLIHVANNNYDPWSIYAIGGSSNPTILSEGNSFTAPNDSDKKEVTRRVGCESPSTCANWVWRSTQDSFNNGAYFVSSGKNEGTNIYNNNEAFKVENGSAAPQLTKNAGVLTCILSKPCS

SEQ ID NO: 1847 - protein, 514 aa, Chamaecyparis obtusa (Japanese cypress)
MGMKFMAAVAFLALQLIVMAAAEDQSAQIMLDSDIEQYLRSNRSLKKLVHSRHDAATVFNVEQYGAVGDGKHDSTEAFATTWNAACKKASAVLLVPANKKFFVNNLVFRGPCQPHLSFKVDGTIVAQPDPARWKNSKIWLQFAQLTDFNLMGTGVIDGQGQQWWAGQCKVVNGRTVCNDRNRPTAIKIDYSKSVTVKELTLMNSPEFHLVFGECEGVKIQGLKIKAPRDSPNTDGIDIFASKRFHIEKCVIGTGDDCIAIGTGSSNITIKDLICGPGHGISIGSLGRDNSRAEVSHVHVNRAKFIDTQNGLRIKTWQGGSGLASYITYENVEMINSENPILINQFYCTSASACQNQRSAVQIQGVTYKNIHGTSATAAAIQLMCSDSVPCTGIQLSNVSLKLTSGKPASCVDKNARGFYSGRLIPTCKNLRPGPSPKEFELQQQPTTVMDENKGACAKGDSTCISLSSSPPNCKNKCKGCQPCKPKLIIVHPNKPQDYYPQKWVCSCHNKIYNP

SEQ ID NO: 1848 - protein, 374 aa, Cryptomeria japonica (Sugi)
MDSPCLVALLVFSFVIGSCFSDNPIDSCWRGDSNWAQNRMKLADCAVGFGSSTMGGKGGDLYTVTNSDDDPVNPAPGTLRYGATRDRPLWIIFSGNMNIKLKMPMYIAGYKTFDGRGAQVYIGNGGPCVFIKRVSNVIIHGLYLYGCSTSVLGNVLINESFGVEPVHPQDGDALTLRTATNIWIDHNSFSNSSDGLVDVTLTSTGVTISNNLFFNHHKVMLLGHDDAYSDDKSMKVTVAFNQFGPNCGQRMPRARYGLVHVANNNYDPWTIYAIGGSSNPTILSEGNSFTAPNESYKKQVTIRIGCKTSSSCSNWVWQSTQDVFYNGAYFVSSGKYEGGNIYTKKEAFNVENGNATPQLTKNAGVLTCSLSKRC

SEQ ID NO: 1849 - protein, 374 aa, Cryptomeria japonica (Sugi); identical to SEQ ID NO: 1848

SEQ ID NO: 1850 - protein, 514 aa, Cupressus arizonica (Cypress)
MAMKFIAPMAFVAMQLIIMAAAEDQSAQIMLDSDIEQYLRSNRSLRKVEHSRHDAINIFNVEKYGAVGDGKHDCTEAFSTAWQAACKKPSAMLLVPGNKKFVVNNLFFNGPCQPHFTFKVDGIIAAYQNPASWKNNRIWLQFAKLTGFTLMGKGVIDGQGKQWWAGQCKWVNGREICNDRDRPTAIKFDFSTGLIIQGLKLMNSPEFHLVFGNCEGVKIIGISITAPRDSPNTDGIDIFASKNFHLQKNTIGTGDDCVAIGTGSSNIVIEDLICGPGHGISIGSLGRENSRAEVSYVHVNGAKFIDTQNGLRIKTWQGGSGMASHIIYENVEMINSENPILINQFYCTSASACQNQRSAVQIQDVTYKNIRGTSATAAAIQLKCSDSMPCKDIKLSDISLKLTSGKIASCLNDNANGYFSGHVIPACKNLSPSAKRKESKSHKHPKTVMVKNMGAYDKGNRTRILLGSRPPNCTNKCHGCSPCKAKLVIVHRIMPQEYYPQRWMCSRHGKIYHP

SEQ ID NO: 1851 - protein, 367 aa, Cupressus sempervirens (Common cypress)
MDSPCLIAVLVFLCAIVSCYSDNPIDSCWRGDSNWDQNRMKLADCAVGFGSSTMGGKGGDIYTATSAEDNPVNPTPGTLRYGATREKALWIIFSQNMNIKLKMPLYVAGHKTIDGRGADVHLGNGGPCLFMRKVSHVILHGLHIHGCNTSVLGDVLVSESIGVEPVHAQDGDAITMRNVTNAWIDHNSLSDCSDGLIDVTLSSTGITISNNHFFNHHKVMLLGHDDTYDDDKSMKVTVAFNQFGPNAGQRMPRARYGLVHVANNNYDQWNIYAIGGSSNPTILSEGNSFAAPNENYKKEVTKRIGCESTSACANWVWRSTRDAFSNGAYFVSSGKTEETNIYNSNEAFKVENGNLAPQLTKNAGVVA

SEQ ID NO: 1852 - protein, 367 aa, Cupressus sempervirens (Common cypress)
MDSPCLIAVLVFLCAIVSCYSDNPIDSCWRGDSNWDQNRMKLADCAVGFGSSTMGGKGGDIYTVTSAEDNPVNPTPGTLRYGATREKALWIIFSQNMNIKLEMPLYVAGHKTIDGRGADVHLGNGGPCLFMRKVSHVILHGLHIHGCNTSVLGDVLVSESIGVEPVHAQDGDAITMRNVTNAWIDHNSLSDCSDGLIDVTLSSTGITISNNHFFNHHKVMLLGHDDTYDDDKSMKVTVAFNQFGPNAGQRMPRARYGLVHVANNNYDQWNIYAIGGSSNPTILSEGNSFTAPNENYKKEVTKRIGCESTSACANWVWRSTRDAFSNGAYFVSSGKTEETNIYNSNEAFKVENGNLAPQLTKNAGVVA

SEQ ID NO: 1853 - protein, 367 aa, Cupressus sempervirens (Common cypress)
MDSPCLIAVLVFLCAIVSCYSDNPIDSCWRGDSNWDQNRMKLADCAVGFGSSTMGGKGGDIYTVTSAEDNPVNPTPGTLRYGATREKALWIIFSQNMNIKLKMPLYVAGHKTIDGRGADVHLGNGGPCLFMRKVSHVILHGLHIHSCNTSVLGDVLVSESIGVEPVHAQDGDAITMRNVTNAWIDHNSLPDCSDGLIDVTLSSTGITISNNHFFNHHKVMLLGHDDTYDDDKSMKVTVAFNQFGPNAGQRMPRARYGLVHVANNNYDQWNIYAIGGSSNPTILSEGNSFTAPNENYKKEVTKRIGCESTSACANWVWRSTRDAFSNGAYFVSSGKTEETNIYNSNEAFKVENGNLAPQLTKNAGVVA

SEQ ID NO: 1854 - protein, 367 aa, Cupressus sempervirens (Common cypress)
MDSPCLIAVLVFLCAIVSCYSDNPIDSCWRGDSNWDQNRMKLADCAVGFGSSTMGGKGGDIYTVTSAEDNPVNPTPGTLRYGATREKALWIIFSQNMNIKLKMPLYVAGHKTIDGRGADVHLGNGGPCLFMRKVSHVILHGLHIHGCNTSVLGNVLVSESIGVEPVHAQDGDAITMRNVTNAWIDHNSLSDCSDGLIDVTLSSTGITISNNHFFNHHKVMLLGHDDTYDDDKSMKVTVAFNQFGPNAGQRMPRARYGLVHVANNNYDQWNIYAIGGSSNPTILSEGNSFAAPNENYKKEVTKRIGCVSTSACANWVWRSTRDAFSNGAYFVSSGKTEETNIYNSNEAFKVENGNLAPQLTKNAGVVA

SEQ ID NO: 1855 - protein, 367 aa, Cupressus sempervirens (Common cypress)
MDSPCLIAVLVFLCAIVSCYSDNPIDSCWRGDSNWDQNRMKLADCAVGFGSSTMGGKGGDIYTVTSAEDNPVNPTPGTLRYGATREKALWIIFSQNMNIKLKMPLYVAGHKTIDGRGADVHLGNGGPCLFMRKVSHVILHGLHIHGCNTSVLGNVLVSESIGVEPVHAQDGDAITMRNVTNAWIDHNSLSDCSDGLIDVTLSSTGITISNNHFFNHHKVMLLGHDDTYDDDKSMKVTVAFNQFGPNAGQRMPRARYGLVHVANNNYDQWNIYAIGGSSNPTILSEGNSFAAPNENYKKEVTKRIGCVSTSACANWVWRSTRDAFSNGAYFVSSGKTEETNIYTSNEAFKVENGNLAPQLTKNAGVVA

SEQ ID NO: 1856 - protein, 164 aa, Cupressus sempervirens (Common cypress)
DVAIVFNVEHTLSAVFLVPANKKVDGIIAAYPDPVKIWMHFARTVCNDKGRPTAIKIDFSKSELTLMNSPEFHLVFGECDGVKIQGIKIKRFEIEKDLTCGPGHGMSIGSLGKGNSRSEVSFVHLDGAKFIDTQNGLRSAVKIEDVTFKNANGYYTNPLNPPCK

SEQ ID NO: 1857 - protein, 225 aa, Cupressus sempervirens (Common cypress)
MARVSELALLLVATSAISLHMQEAGAVKFDIKNQCRYTVWAAGLPGGGKRLDQGQTWTVNLAAGTASARFWGRTGCTFDASGKGSCRSGDCGGQLSCTVSGAVPATLAEYTQSDQDYYDVSLVDGFNIPLAINPTNTKCTAPACKADINAVCPSELKVDGGCNSACNVLQTDQYCCRNAYVDNCPATNYSKIFKNQCPQAYSYAKDDTATFACASGTDYSIVFCP

SEQ ID NO: 1858 - protein, 225 aa, Cupressus sempervirens (Common cypress)
MARVSELALLLVATLAISLHMQEAGAVKFDIKNQCGYTVWAAGLPGGGKRLDQGQTWTVNLAAGTASARFWGRTGCTFDASGKGSCRSGDCGGQLSCTVSGAVPATLAEYTQSDKDYYDVSLVDGFNIPLAINPTNTKCTAPACKADINAVCPSELKVDGGCNSACNVLQTDQYCCRNAYVDNCPATNYSKIFKNQCPQAYSYAKDDTATFACASGTDYSIVFCP

SEQ ID NO: 1859 - protein, 367 aa, Juniperus ashei (Mountain cedar)
MASPCLIAVLVFLCAIVSCYSDNPIDSCWRGDSNWDQNRMKLADCAVGFGSSTMGGKGGDFYTVTSTDDNPVNPTPGTLRYGATREKALWIIFSQNMNIKLKMPLYVAGHKTIDGRGADVHLGNGGPCLFMRKVSHVILHSLHIHGCNTSVLGDVLVSESIGVEPVHAQDGDAITMRNVTNAWIDHNSLSDCSDGLIDVTLGSTGITISNNHFFNHHKVMLLGHDDTYDDDKSMKVTVAFNQFGPNAGQRMPRARYGLVHVANNNYDPWNIYAIGGSSNPTILSEGNSFTAPSESYKKEVTKRIGCESPSACANWVWRSTRDAFINGAYFVSSGKTEETNIYNSNEAFKVENGNAAPQLTKNAGVVT

SEQ ID NO: 1860 - protein, 507 aa, Juniperus ashei (Mountain cedar)
MSMKFMAALAFLALQLIVMAAGEDQSAQIMLDSDTKQYHRSSRNLRKRVHHARHDVAIVFNVEHYGAVGDGKHDSTDAFEKTWNAACNKLSAVFLVPANKKFVVNNLVFYGPCQPHFSFKVDGTIAAYPDPAKWKNSKIWMHFARLTDFNLMGTGVIDGQGNRWWSDQCKTINGRTVCNDKGRPTAIKIDFSKSVTVKELTLTNSPEFHLVFGECDGVKIQGIKIKAPRDSPNTDGIDIFASKRFEIEKCTIGTGDDCVAVGTGSSNITIKDLTCGPGHGMSIGSLGKGNSRSEVSFVHLDGAKFIDTQNGLRIKTWQGGSGLASHITYENVEMINAENPILINQFYCTSAAACKNQRSAVKIQDVTFKNIHGTSATTAAIQLMCSDSVPCSNIKLSNVFLKLTSGKVATCVNKNANGYYTNPLNPSCKSLHPGRTPKELELHQKPTTLLMDEKMGASLNSSPPNCKNKCKGCQPCKPKLIIVHPNQPEDYYPQRWVCSCHNKIYNP

SEQ ID NO: 1861 - protein, 225 aa, Juniperus ashei (Mountain cedar)
MARVSELAFLLAATLAISLHMQEAGVVKFDIKNQCGYTVWAAGLPGGGKRLDQGQTWTVNLAAGTASARFWGRTGCTFDASGKGSCQTGDCGGQLSCTVSGAVPATLAEYTQSDQDYYDVSLVDGFNIPLAINPTNAQCTAPACKADINAVCPSELKVDGGCNSACNVFKTDQYCCRNAYVDNCPATNYSKIFKNQCPQAYSYAKDDTATFACASGTDYSIVFCP

SEQ ID NO: 1862 - protein, 165 aa, Juniperus oxycedrus (Prickly juniper)
MDEVPSSDGSKSACSGEVVMEQSVHELEEVFKKFDANGDGKISGSELADILRSLGSDVGEAEVKAMMEEADADGDGYVSLQEFVDLNNKGASVKDLKNAFKVFDRDCNGSISAAELCHTLESVGEPCTIEESKNIIHNVDKNGDGLISVEEFQTMMTSEMTDKSK

SEQ ID NO: 1863 - protein, 367 aa, Juniperus virginiana (Eastern red cedar)
MASPCLIAFLVFLCAIVSCCSDNPIDSCWRGDSNWGQNRMKLADCAVGFGSSTMGGKGGDFYTVTSADDNPVNPTPGTLRYGATREKTLWIIFSQNMNIKLKMPLYVAGHKTIDGRGADVHLGNGGPCLFMRKVSHVILHGLHIHGCNTSVLGDVLVSESIGVVPVHAQDGDAITMRNVTNAWIDHNSLSDCSDGLIDVTLGSTGITISNNHFFNHHKVMLLGHDDTYDDDKSMKVTVAFNQFGPNAGQRMPRARYGLVHVANNNYDPWNIYAIGGSSNPTILSEGNSFTAPNENYKKEVTKRIGCESTSACANWVWRSTRDAFSNGAYFVSSGKIEETNIYNSNEAFKVENGNAAPQLTKNAGVVA

SEQ ID NO: 1864 - protein, 110 aa, Juniperus virginiana (Eastern red cedar)
AFLLAATLTISSHMQEAGAVKFDIKNQCGYTVWAAGLPGGGKRLDQGQTWTVNLAAGTASARFWGRTGCTFDASGKGSCQTGDCGRQLSCTVSGAVPATLAEYTQSDQDY

SEQ ID NO: 1865 - protein, 463 aa, Pinus koraiensis (Korean Pine)
MAFVSLLTILLAISSSSVALTEPVASMADQGVFPEQHGRGHHGVFPEEHGRGHHRGGREEEREENPYVFHSDRFRIRASSEAGEIRALPNFGEVSELLEGISRYRVTCIEMKPNTVMLPHYIDAKWILYVTGGRGYIAYVQQNELVKRKLEEGDVFGVPSGHTFYLVNNDDHNSLRIASLLRTESTMRGEYEPFYVAGGRNPETVYSAFSDDVLEAAFNTDVQKLEHIFGAHRRGVIFYANEEQIREMMRRGGFSAESTSASEQPKPFNLRNQKPDFENDNGRFTRAGPKDNPFLDSVDVTVGFGVLNPGTMTAPSHNTKATSIAIVMEGEGRIEMACPHLGQEHGWSSPRERGHQDINYERVRARLRTGTVYVVPAGHPITEIASTNGRLEILWFDINTSGNEREFLAGKNNVLQTLEKEVRHLSFNIPRGEEIEEVLQAQKDQVILRGPQRQRRDEPRSSS

SEQ ID NO: 1866 - protein, 164 aa, Pinus pinea (Stone pine)
MGVFSSPMSTLRWVTLFAALLSLLEWGTAHEDIVMDGDQVVQQQGRSCDPQRLSACRDYLQRRREQPSERCCEELQRMSPHCRCRAIERALDQSQSYDSSTDSDSQDGAPLNQRRRRRGEGRGREEEEAVERAEELPNRCNLRESPRRCDIRRHSRYSIIGGSD

The invention claimed is:

1. An allergen detection agent comprising:
   (a) a solid substrate,
   (b) an allergen binding signaling polynucleotide (SPN) comprising a nucleotide sequence that binds a target allergen and having a 3' and 5' end, the SPN immobilized to the solid substrate,
   (c) a complement comprising a nucleotide sequence complementary to a region of the SPN sequence, wherein the complement is competitive with the target allergen for binding to the SPN, and
   (d) a fluorophore,
   wherein the SPN and the complement is at a ratio of 1:5, or at a ratio of 1:4, or at a ratio of 1:3, or at a ratio of 1:2.

2. The allergen detection agent of claim 1 wherein the complement comprises 5-20 nucleotide residues, or 10-20 nucleotide residues.

3. The allergen detection agent of claim 1, wherein the SPN is immobilized to the surface of the solid substrate through a short poly(A) tail and a PEG-amine linker at one end of said SPN sequence.

4. The allergen detection agent of claim 3 wherein the solid substrate is selected from the group consisting of a magnetic particle, a glass slide, a silicon chip, a wafer or a microwell plate.

5. The allergen detection agent of claim 4 wherein the solid substrate is a magnetic particle.

6. The allergen detection agent of claim 5 wherein the complementary sequence is labeled with the fluorophore at one end;
   alternatively wherein the SPN sequence is labeled with the fluorophore at the free end which is not bound to the surface of the magnetic particle and the complementary sequence is labeled with a fluorophore quencher at one end; or
   alternatively wherein the complementary sequence is labeled with a first fluorophore at one end and the SPN sequence is labeled with a second fluorophore at the free end which is not bound to the surface of the magnetic particle.

7. The allergen detection agent of claim 6 wherein the fluorophore is selected from the group consisting of Texas red, Alex 647, Cy3-FITC and Cy5.

8. The allergen detection agent of claim 6 wherein the SPN and the complementary sequence is at a ratio of 1:2, or at a ratio of 1:3, or at a ratio of 1:4.

9. The allergen detection agent of claim 8 wherein the SPN sequence is selected from the group consisting of nucleotide sequences presented by SEQ ID NOs.: 1-696.

10. An allergen detection agent comprising:
(a) a solid substrate,
(b) an allergen binding signaling polynucleotide (SPN) comprising a nucleotide sequence that binds a target allergen and having a 3' and 5' end,
(c) a complement comprising a nucleotide sequence complementary to a region of the SPN sequence, wherein the complement is competitive with the target allergen for binding to the SPN, and
wherein the complementary sequence is immobilized to the surface of the solid substrate; and
(d) a fluorophore.

11. The allergen detection agent of claim 10 wherein the complementary sequence binds to the SPN when the SPN sequence is not bound to the target allergen.

12. The allergen detection agent of claim 11 wherein the solid substrate is magnetic particles, a glass slide, a silicon chip, a wafer or a microwell plate.

13. The allergen detection agent of claim 12 wherein the solid substrate is a glass slide.

14. The allergen detection agent of claim 13 wherein one end of the SPN sequence is labeled with the fluorophore.

15. The allergen detection agent of claim 13 wherein the complementary sequence is immobilized to the surface of the glass slide through a covalent reaction using an amine group, a thiol group, or a biotin-streptavidin linkage.

16. The allergen detection agent of claim 15, wherein the surface of the glass slide is further coated with PEG polymers.

17. The allergen detection agent of claim 13 wherein the complementary sequence is immobilized to the surface of the solid substrate by in situ synthesis that is mediated by a non-cleavable linker.

18. The allergen detection agent of claim 17 wherein a spacer is attached to the non-cleavable linker which increases the space between the complementary sequences to facilitate hybridization of the SPN sequence.

19. The allergen detection agent of claim 13 wherein the SPN sequence is selected from the group consisting of nucleotide sequences presented by SEQ ID NOs.: 1-696.

20. A complex for detecting an allergen comprising:
(a) an allergen binding signaling polynucleotide (SPN) comprising a nucleotide sequence selected from the group consisting of nucleotide sequences presented by SEQ ID NOs. 1-696;
(b) a complement comprising a nucleotide sequence complementary to a region the SPN sequence wherein the complement comprises 5-20 nucleotide residues, wherein the complement is competitive with the target allergen for binding to the SPN; and
(c) a fluorophore,
wherein the SPN and the complement is at a ratio of 1:5, or at a ratio of 1:4, or at a ratio of 1:3, or at a ratio of 1:2, and wherein the complement is immobilized to a solid substrate, or alternatively the SPN is immobilized to a solid substrate.

21. The complex of claim 20 wherein the SPN and the complement is at a ratio of 1:4, or at a ratio of 1:3, or at a ratio of 1:2.

22. The complex of claim 21 wherein the solid substrate is selected from the group consisting of magnetic particles, a glass slide, a silicon chip, a wafer and a microwell plate.

23. The complex of claim 22 wherein the complement sequence of the complex is immobilized on the surface of the solid substrate at one end, or alternatively the SPN sequence of the complex is immobilized on the surface of the solid substrate at one end.

24. A method for detecting the absence, presence and/or quantity of an allergen of interest in a sample comprising:
(a) obtaining and processing a sample suspected to contain the allergen of interest;
(b) contacting the processed sample with a detection agent;
(c) shaking the mixture and washing the mixture containing the allergen of interest and the detection agent;
(d) detecting the complexes formed by the detection agent and the allergen of interest in the mixture; and
(e) processing and analyzing the detection signals to determine the absence, presence, and/or the quantity of the allergen of interest in the sample,
wherein the detection agent is a complex that includes a signaling polynucleotide (SPN) comprising a nucleotide sequence that specifically binds the allergen of interest, a complement comprising a nucleotide sequence complementary to the SPN sequence, wherein the complement is competitive with the target allergen for binding to the SPN, a solid substrate to which either the SPN or the complement is immobilized, and a fluorophore, wherein the SPN and the complement is at a ratio of 1:5, or at a ratio of 1:4, or at a ratio of 1:3, or at a ratio of 1:2.

25. The method of claim 24 wherein the solid substrate is selected from magnetic particles, a glass slide, a silicon chip, a wafer or a microwell plate.

26. The method of claim 25 wherein the SPN sequence is immobilized to the surface of the solid substrate at one end.

27. The method of claim 26 wherein the solid substrate is magnetic particles.

28. The method of claim 27 wherein the complementary sequence is labeled with the fluorophore at one end; or alternatively wherein the SPN sequence is labeled with the fluorophore at the free end which is not bound to the surface of the magnetic particle and the complementary sequence is labeled with a fluorophore quencher at one end; or
alternatively wherein the complementary sequence is labeled with a first fluorophore at one end and the SPN sequence is labeled with a second fluorophore at the free end which is not bound to the surface of the magnetic particle.

29. The method of claim 28 wherein the SPN and the complement is at a ratio of 1:4, or at a ratio of 1:3, or at a ratio of 1:2.

30. The method of claim 25 wherein the complement is immobilized to the surface of the solid substrate and wherein the SPN is labeled with a fluorophore at one end of the sequence.

31. The method of claim 30 wherein the solid substrate is a glass slide.

32. The method of claim 24 wherein the SPN comprises a nucleotide sequence selected from the group consisting of nucleotide sequences presented by SEQ ID NOs. 1-696.

* * * * *